(12) United States Patent
Kelner

(10) Patent No.: US 11,135,182 B2
(45) Date of Patent: Oct. 5, 2021

(54) AFFINITY MEDICANT CONJUGATES

(71) Applicant: AF Chemicals, LLC, San Diego, CA (US)

(72) Inventor: Michael Kelner, La Jolla, CA (US)

(73) Assignee: AF CHEMICALS, LLC, San Diego, CA (US)

( * ) Notice: Subject to any disclaimer, the term of this patent is extended or adjusted under 35 U.S.C. 154(b) by 0 days.

(21) Appl. No.: 17/035,529

(22) Filed: Sep. 28, 2020

(65) Prior Publication Data

US 2021/0077425 A1 Mar. 18, 2021

Related U.S. Application Data

(63) Continuation-in-part of application No. 15/986,727, filed on May 22, 2018, now Pat. No. 10,806,708, which is a continuation of application No. 15/201,301, filed on Jul. 1, 2016, now Pat. No. 9,980,926, which is a continuation of application No. 14/684,218, filed on Apr. 10, 2015, now Pat. No. 9,381,178.

(60) Provisional application No. 61/978,195, filed on Apr. 10, 2014.

(51) Int. Cl.
| A61K 31/122 | (2006.01) |
| A61K 47/59 | (2017.01) |
| A61K 47/68 | (2017.01) |
| A61K 47/64 | (2017.01) |
| A61K 47/55 | (2017.01) |
| A61K 47/54 | (2017.01) |
| A61K 47/62 | (2017.01) |
| A61K 47/65 | (2017.01) |
| A61K 47/58 | (2017.01) |
| A61K 31/19 | (2006.01) |

(52) U.S. Cl.
CPC ............ *A61K 31/122* (2013.01); *A61K 31/19* (2013.01); *A61K 47/55* (2017.08); *A61K 47/551* (2017.08); *A61K 47/554* (2017.08); *A61K 47/58* (2017.08); *A61K 47/59* (2017.08); *A61K 47/593* (2017.08); *A61K 47/62* (2017.08); *A61K 47/64* (2017.08); *A61K 47/642* (2017.08); *A61K 47/6415* (2017.08); *A61K 47/65* (2017.08); *A61K 47/68* (2017.08); *A61K 47/6803* (2017.08); *A61K 47/6889* (2017.08)

(58) Field of Classification Search
CPC ..... A61K 31/122; A61K 47/58; A61K 47/593
See application file for complete search history.

(56) References Cited

U.S. PATENT DOCUMENTS

| 3,230,201 A | 1/1966 | Hart |
| 5,439,936 A | 8/1995 | Kelner |
| 5,439,942 A | 8/1995 | Kelner |
| 5,523,490 A | 6/1996 | Kelner |
| 5,563,176 A | 10/1996 | Kelner |
| 5,723,632 A | 3/1998 | McMorris |
| 5,932,553 A | 8/1999 | McMorris |
| 6,025,328 A | 2/2000 | McMorris |
| 6,069,283 A | 5/2000 | McMorris |
| 6,160,184 A | 12/2000 | McMorris |
| 6,252,093 B1 | 6/2001 | McMorris |
| 6,323,181 B1 | 11/2001 | McMorris |
| 6,380,403 B1 | 4/2002 | McMorris |
| 6,469,184 B1 | 10/2002 | McMorris |
| 6,548,679 B1 | 4/2003 | McMorris |
| 6,639,105 B2 | 10/2003 | McMorris |
| 6,717,017 B2 | 4/2004 | McMorris |
| 6,855,696 B2 | 2/2005 | McMorris |
| 6,908,918 B2 | 6/2005 | McMorris |
| 6,987,193 B2 | 1/2006 | McMorris |
| 7,141,603 B2 | 11/2006 | McMorris |
| 7,329,759 B2 | 2/2008 | McMorris |
| 7,629,380 B2 | 12/2009 | McMorris |
| 7,655,695 B2 | 2/2010 | McMorris |
| 7,713,939 B2 | 5/2010 | McMorris |
| 7,855,275 B2 | 12/2010 | Eigenbrot |
| 8,937,161 B2 | 1/2015 | Mao |
| 9,381,178 B2 * | 7/2016 | Kelner ............... A61K 47/6415 |
| 9,725,769 B1 | 8/2017 | Knudsen |
| 9,980,926 B1 * | 5/2018 | Kelner ................ A61K 47/68 |
| 10,285,955 B2 * | 5/2019 | Kelner ................ A61K 31/122 |

(Continued)

FOREIGN PATENT DOCUMENTS

| WO | PCT/US2005/017804 | 12/2005 |
| WO | PCT/US2015/025208 | 10/2015 |

OTHER PUBLICATIONS

A. Annamalai et al., Reaction of the Adenine Nucleotide Analogue W-p-Fluorosulfonylbenzoyl Adenosine at Distinct Tyrosine and Cysteine Residues of Rabbit Muscle Pyruvate Kinase, J. Biol. Chern., 256, 10276-10283, 1981.

(Continued)

*Primary Examiner* — Pancham Bakshi
(74) *Attorney, Agent, or Firm* — Sci-Law Strategies PC

(57) ABSTRACT

In an embodiment of the invention, a composition for treating a cell population comprises an Affinity Medicant Conjugate (AMC). The medicant moiety can be a toxin including an acylfulvene or a drug moiety. The affinity moiety can be an antibody, a binding protein, a steroid, a lipid, a growth factor, a protein, a peptide or non peptidic. The affinity moiety can be covalently bound to the medicant via a linker. Novel linkers that can be directed to cysteine, arginine or lysine residues based on solution pH allow greater flexibility in preserving and/or generating specific epitopes in the AMC.

5 Claims, 27 Drawing Sheets

Specification includes a Sequence Listing.

(56) References Cited

U.S. PATENT DOCUMENTS

| | | | |
|---|---|---|---|
| 10,806,708 B2* | 10/2020 | Kelner | A61K 47/554 |
| 2005/0250675 A1 | 11/2005 | McMorris | |
| 2007/0072790 A1* | 3/2007 | McMorris | C07K 5/0812 |
| | | | 514/462 |
| 2007/0092940 A1 | 4/2007 | Eigenbrot | |
| 2008/0306147 A1 | 12/2008 | McMorris | |
| 2011/0033378 A1 | 2/2011 | Dimasi | |
| 2018/0100197 A1 | 4/2018 | Knudsen | |
| 2019/0231795 A1 | 8/2019 | Knudsen | |
| 2020/0340067 A1 | 10/2020 | Knudsen | |

OTHER PUBLICATIONS

E. Brandsteterova, M.J. Kelner, T.C. McMorris, W. Wang, and R. Bagnell. HPLC analysis of novel anticancer agents Illudins and analogs. *J. Liquid Chromatography.* 16:115-126, 1993.

E. Brandsteterova, M.J. Kelner, T.C. McMorris, L. Estes, R. Bagnell, and M. Montoya.HPLC determination of a new anticancer agent (acylfulvene).in serum. *Neoplasma* 39:369-373, 1992.

R.F. Colman, Affinity Labelling of Purine Nucleotide Sites in proteins, 52, 67-91, 1983.

SR Demeade et al., Prostate-Specific Antigen-Activated Thapsigargin Prodrug as Targeted Therapy for Prostate Cancer, JNCI 95, 990, 2003.

R.P.M. Dings, et al., Chapter 18: Non-peptidic mimietics as cancer-sensitizing agents. In: Sensitization of cancer cells for Chemo/Immuno/Radiotherapy, 305-325.Editor Benjamin Bonavida, Human Press, 2008.

R.P. M. Dings, et al., Inhibiting Tumor Growth by Targeting Tumor Vasculature with Galectin-1 Antagonist Anginex Conjugated to the Cytotoxic Acylfulvene, 6-Hydroxylpropylacylfulvene. Bioconjugate Chemistry 21:20-27, 2010.

R.P. M. Dings, et al., Ovarian tumor growth regression using a combination of vascular targeting agents anginex or topomimetic 0118 and the chemotherapeutic irofulven. Cancer Letters 265: 270-280, 2008.

K.E. Dombrowski, et al., 5'-p-(Fluorosulfonyl)benzoyl-8-azidoadenosine: A New Bifunctional Affinity Label for Nucleotide Binding Sites in Proteins, Arch. Biochem. Biophys. 275, 302-308, 1989.

F.S. Esch et al., A procedure for the synthesis of p-Fluorosulfonyl[14C]benzoyl-5'-Adenosine with [14C] in the benzoyl moiety, Anal Biochem., 84, 642-645, 1978.

F.S. Esch et al., Identification of a tyrosine residue at a nucleotide binding site in the B subunit of the mitochondrial ATPase with p-Fluorosulfonyl[14C]benzoyl-5'-Adenosine, J. Biol. Chem., 253, 6100-6106, 1978.

VM Garsky, The Synthesis of a Prodrug of Doxorubicin Designed to Provide Reduced Systemic Toxicity and Greater Target Efficacy, J. Med. Chem. 44, 4216-4224, 2001.

M. Jaffe et al., Use of 5'-[p-Fluorosulfonylbenzoyl] guanosine as an affinity probe for the Guanine Nucleotide Binding Site of Transducin, The Prot. Journal, 26, 125-133, 2007.

N.G.J. Jaspers, et al., Anti-tumor compounds illudin S and Irofulven induce DNA lesions ignored by global repair and exclusively processed by transcription- and replication-coupled repair pathways. *DNA Repair* 1:1027-1038, 2002.

M.J. Kelner, et al., Preclinical evaluations of Illudins as anticancer agents. *Cancer Res.* 47:3186-9, 1987.

M.J. Kelner, et al., Preclinical evaluation of Illudins as anti-cancer agents. Basis for selective cytotoxicity. *J. Natl. Cancer Inst.* 82:1562-1565, 1990.

M.J. Kelner, et al., Characterization of Illudin S sensitivity of DNA repair-deficient Chinese Hamster cells: unusually high sensitivity of ERCC2 and ERCC3 DNA-helicase deficient mutants in comparison to other chemotherapeutic agents. *Biochem. Pharmacol.* 48:403-409, 1994.

M.J. Kelner, et al., Nonresponsiveness of the metastatic human lung carcinoma MV522 xenograft to conventional anticancer agents. *Anticancer Res.* 15:867-872, 1995.

M.J. Kelner, et al., In vitro and In vivo studies on the anticancer activity of dehydroilludin M. *Anticancer Res.* 15:873-878, 1995.

M.J. Kelner, et al., Efficacy of Acylfulvene Illudin analogs against a metastatic lung carcinoma MV522 xenograft nonresponsive to traditional anticancer agents retention of activity against various mdr phenotypes and unusual cytotoxicity against ERCC2 and ERCC3 DNA helicase-deficient cells. *Cancer Res.* 55:4936-4940, 1995.

M.J. Kelner, et al., Efficacy of HMAF (MGI-114) in the MV522 metastatic lung carcinoma xenograft model nonresponsive to traditional anticancer agents. *Invest. New Drugs* 14:161-167, 1996.

M.J. Kelner, et al., Characterization of cellular accumulation and toxicity of Illudin S in sensitive and non-sensitive tumor cells. *Cancer Chemother. Pharmacol.* 40:65-71, 1997.

M.J. Kelner, et al., Characterization of Acylfulvene histiospecific toxicity in human tumor cell lines. *Cancer Chemother. Pharmacol.* 41:237-242, 1998.

M.J. Kelner, et al., Efficacy of MGI 114 (6-hydroxymethylacylfulvene, HMAF) against the mdrl/gpl70 Metastatic MV522 lung carcinoma xenograft. *Eur. J. Cancer.* 34:908-913, 1998.

M.J. Kelner, et al., Characterization of MGI 114 (HMAF): Histiospecific toxicity in human tumor cell lines. *Cancer Chemother. Pharmacol.* 44:235-240, 1999.

M.J. Kelner, et al., Anti-leukemic action of the novel agent MGI 114 (HMAF) and synergistic action with Topotecan. *Leukemia* 14:136-141, 2000.

M.J. Kelner, et al., Efficacy of MGI 114 against the MRP-positive metastatic MV522 lung carcinoma Xenograft. *Anti-Cancer Drugs* 11: 217-224, 2000.

M.J. Kelner, et al., Enhanced antitumor activity of irofulven in combination with thiotepa or mitomycin C. *Cancer Chemother. Pharmacol.* 49:412-8, 2002.

M.J. Kelner, et al., Enhanced antitumor activity of Irofulven in combination with antimitotic agents. *Invest New Drugs* 20:271-279, 2002.

M.J. Kelner, et al., Synergy of Irofulven in combination with other DNA damaging Agents: synergistic interaction with altretamine, alkylating, and platinum-derived agents in the MV522 lung tumor model. *Cancer Chemotherap Pharmacol.* 63:19-26, 2008.

M.J. Kelner, et al., Synergy of Irofulven in combination with various anti-metabolites, enzyme inhibitors, and miscellaneous agents in MV522 lung carcinoma cells: marked interaction with gemcitabine and 5-fluorouracil. *Invest. New Drugs.* 26:407-415, 2008.

J.J. Likos et al., Affinity labelling of the active site of yeast Pyruvate Kinase by 5'-p-Fluorosulfonyl benzoyl Adenosine, J. Biol. Chem., 255, 9388-9398, 1980.

J.R. MacDonald, et al., Preclinical antitumor activity of 6-Hydroxymethylacylfulvene, a semisynthetic derivative of the mushroom toxin Illudin S. *Cancer Res.* 57:279-283, 1997.

T.C. McMorris, et al., Structure and reactivity of Illudins. *Tetrahedron* 45:5433-5440, 1989.

T.C. McMorris, et al., On the mechanism of toxicity of Illudins. The role of glutathione. *Chem. Res. Toxicol.* 3:574-579, 1990.

T.C. McMorris, et al., Structure activity-relationships of Illudins Analogs with improved therapeutic index. *J. Org. Chem.* 57:6876-6883, 1992.

T.C. McMorris, et al., Acylfulvenes, a new class of potent antitumor agents. *Experientia* 52:75-80, 1996.

T.C. McMorris, et al., (Hydroxymethyl)acylfulvene: an Illudin derivative with superior antitumor properties. *J. Natural Products* 59:896-899, 1996.

T.C. McMorris, et al., Total synthesis of Hydroxymethylacylfulvene; an antitumor derivative of Illudin S. *Chem. Commun.* 3:315-316, 1997.

T.C. McMorris, et al., An Acetal derivative of Illudin S with improved tumor activity. *Tetrahedron Lett.* 38:1697-1698, 1997.

T.C. McMorris, et al., The design and total synthesis of antitumor acylfulvenes. *J. Organic Chem.* 62:3015-3018, 1997.

T.C. McMorris, et al., Reaction of antitumor hydroxymethylacylfulvene (HMAF) with thiols. *Tetrahedron.*53: 14579-90, 1997.

(56) References Cited

OTHER PUBLICATIONS

T.C. McMorris, et al., Synthesis of [$^3$H]-Illudin S, [$^3$H]-Acylfulvene, [$^3$H] & [$^{14}$C]-Hydroxymethylacylfulvene (MGI 114). *J. Labelled Cpd. Radiopharm.* XLI: 279-285, 1998.
T.C. McMorris, et al., Metabolism of antitumor Acylfulvene by rat liver cytosol. *Biochem. Pharmacol.* 57:83-88, 1999.
T.C. McMorris, et al., Metabolism of antitumor hydroxymethylacylfulvene by rat liver cytosol. *Drug Metab. Dispos.* 27:983-985, 1999.
T.C. McMorris, et al., Preparation and biological activity of amino acid and peptide conjugates of antitumor hydroxymethylacylfulvene. *J. Med. Chem.* 43: 3577-3580, 2000.
T.C. McMorris, et al., Sequiterpenes from the Basidiomycete *Omphalotus illudens. J. Nat. Prod.* 63:1557-1559, 2000.
T.C. McMorris, et al., Structure-activity studies of antitumor agent irofulven (hydroxymethylacylfulvene) and related analogues. *J. Org. Chem.* 66:6158-6163, 2001.
T.C. McMorris, et al., Sesquiterpenes from Omphalotus illudens. *Phytochemistry* 61:395-398, 2002.
T.C. McMorris, et al., Reaction of Irofulven with Zinc and Acid. *J Nat Products*. 66:310-312, 2003.
T.C. McMorris, et al., Structure-activity relationship studies of Illudins: Analogues possessing a spiro-cyclobutane ring. *J. Org. Chem.* 68:9648-53, 2003.
T.C. McMorris, et al., Synthesis and biological activity of enantiomers of antitumor Irofulven. *J. Org. Chem* 69:619-623, 2004.
T.C. McMorris, et al., Synthesis and Antitumor Activity of Amine Analogs of Irofulven *Bioorganic & Medicinal Chemistry Letters*. 17: 6770-72, 2007.
T.C. McMorris, et al., Structure-Activity Studies of Urea, Carbamate and Sulfonamide Derivatives of Acylfulvene. *J. Med. Chem.* 53: 1109-16, 2010.
Narayanan, A. and Jones, L.H. Sulfonyl fluorides as privileged warheads in chemical biology, ChemSci., 6, 2650, 2015.
P.K. Pal et al., Affinity Labeling of a Regulatory Site of Bovine Liver Glutamate Dehydrogenase, Biochem., 14, 707-714, 1975.
P.K. Pal et al., Affinity Labeling of a inhibitory DPNH Site of Bovine Liver Glutamate Dehydrogenase by 5'-Fluorosulfonylbenzoyl Adenosine, J.Biol. Chem. 250, 8140-8147, 1975.
T.L. Poulos, The involvement of serine and carboxyl groups in the activity of Bovine Pancreatic Deoxyribonuclease A, J. Biol. Chem. 249, 1453-1457, 1974.
S. Roy et al., Affinity Labeling of a Lysine Residue in the Coenzyme Binding Site of Pig Heart Mitochondrial Malate Dehydrogenase, Biochemistry, 18, 4683-4690, 1979.
K.V. Saradambal ey al., Lysine and Tyrosine in the NADH Inhibitory Site of Bovine Liver Glutamate Dehydrogenase, *J. Biol. Chem.* 256, 11866-11872, 1981.
R. Schobert, et al., Conjugates of the fungal cytotoxin illudin M with improved tumour specificity. Biorg Med Chem 16:8592-97, 2008.
R. Schobert, et al., Cancer selective metallocenedicarboxylates of the fungal cytotoxin Illudin M. J Med Chem. 54: 6177-82, 2011.
R. Schobert, et al., Anticancer Active Illudins: Recent developments of a potent alkylating compound class. Current Medicinal Chemistry 18:790-807, 2011.
M.D. Staake, et al., Hydroxyurea derivatives of irofulven with improved antitumor efficacy. *Bioorg. Med. Chem. Lett.* 26: 2836-38, 2016.2010.
M. Tanasova, S.J. Sturla. "Chemistry and Biology of Acylfulvenes: Sesquiterpene-derived antitumor agents" (2012) Chemical Reviews. 112, 3578-3610.
C.T. Togashi et al., 5'-p-Fluorosulfonylbenzoyladenosine: Inactivatio of myosine subfragment I and a model reaction with Cysteine (1981) J Biol. Chem. 257, 10112-10118.
J.M. Tomich et al., Modification of two essential cysteines in rabbit muscle pyruvate kinase by the guanosine nucleotide analogue 5'-[p-(Fluorosulfonyl)benzoyl] guanosine, 1981 Biochem, 20, 6711-6720.
PCT/US2015/025208, ISR dated Oct. 23, 2015, 26 pages.
A. Narayanan et al., Sulfonyl fluorides as privileged warheads in chemical biology, Chem Sci, 2650, 6 (2015).
A Paci et al., "Pharmacokinetics, Metabolism, and Routes of Excretion of Intravenous Irofulven in Patients with Advanced Solid Tumors", Drug Metabolism and Disposition, vol. 34, No. 11, Aug. 16, 2006.
J. Gong et al., "Depurinating Acylfulvene-DNA Adducts: Characterizing Cellular Chemical Reactions of a Selective Antitumor Agent", Journal of the American Chemical Society, vol. 129, No. 7, Feb. 1, 2007, pp. 2101-2111.
Partial Supplementary eSR 15776253.5 PCT/US2015/025208, dated Feb. 5, 2018 (stamped by foreign associate as incoming on Jan. 31, 2018), 18 pages.
A. Stornetta, "DNA Adducts from Anticancer Drugs as Candidate Predictive Markers for Precision Medicine", (2017) Chemical Research in Toxicology, 30, 388-409.
A. Intra, "Regioselective Enzymatic Acylation of Polyhydroxylated Sesquiterpenoids" (2004) J. Molecular Catalysis B: Enzymatic 29, 95-98.
C. Nord, "Cytotoxic Illudane Sesquiterpenes from the Fungus Granulobasidium vellereum (Ellis and Cragin) Jülich", J. of Natural Products (2015) 78, 2559-2564.
T. Horn et al., "High-Order Drug Combinations Are Required to Effectively Kill Colorectal Cancer Cells", (2016) Cancer Res. 76, 6950-6963.
K. Mouw, "Improving Methods to Detect and Target Nucleotide Excision Repair (NER) Deficiency in Bladder Cancer" (2020) IBCN, https://www.urotoday.com/conference-highlights/ibcn-2020/125289-ibcn-2020-improving-methods-to-detect-and-target-nucleotide-excision-repair-deficiency-in-bladder-cancer.html, last visited Feb. 25, 2021.
European Search Report, Application 3667323, dated Feb. 11, 2020, 4 pages.
C. McCann et al., "Molecular Targets and Cancer Therapeutics" (2015) Poster Abstract, htpps://www.aacr.org/Documents/Targets15_AbstractsPosterC.pdf.
K. E. Pietsch et al., "Quantification of Acylfulvene- and TIludin S-DNA Adducts in Cells with Variable Bioactivation Capacities" (2013) Chemical Res. In Toxicology, 26 146-155.
W. Yang et al., "Genomics of Drug Sensitivity in Cancer (GDSC): a resource for therapeutic biomarker discovery in cancer cells" (2013) Nucleic Acids Res. 41 D955-D961.

* cited by examiner (H)

(I)

Figure 2P
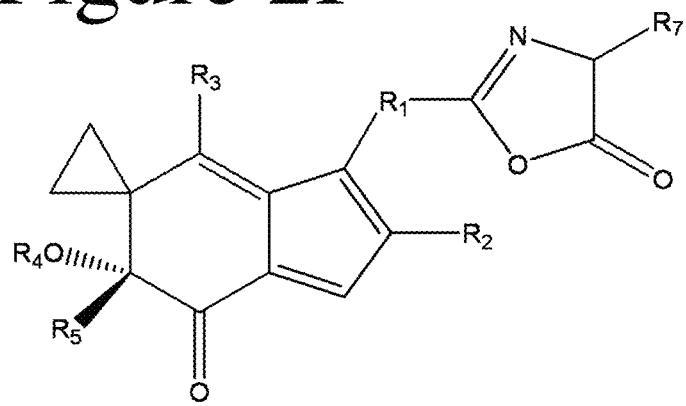
Figure 2Q
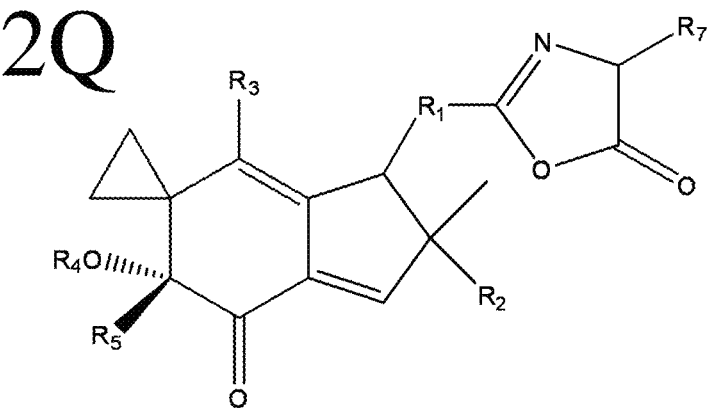
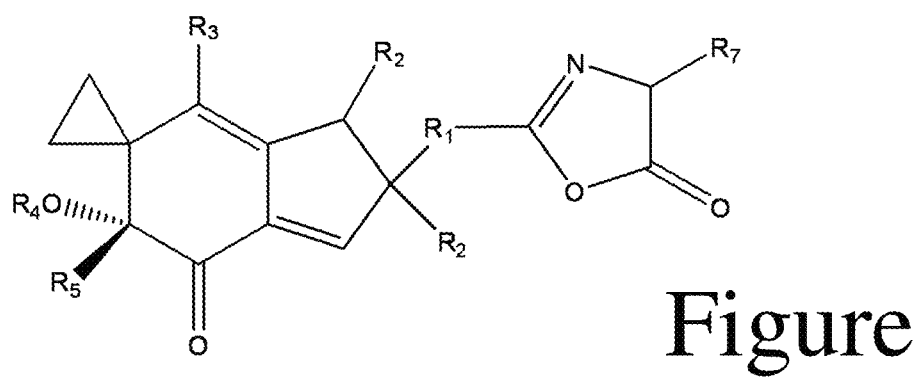
Figure 2R

Figure 4

| Tumor cell line | 2 hr | 48 hr |
|---|---|---|
| Myeloid leukemias | Yes | Yes |
| Breast carcinomas | Yes | Yes |
| Epidermoid | Yes | Yes |
| Ovarian | Yes | Yes |
| Lung carcinomas | Yes | Yes |
| Prostate carcinomas | Yes | Yes |
| B cell leukemias | No | Yes |
| T cell leukemias | No | Yes |
| Fibroblasts (normal) | No | Yes |

Figure 5

Unique DNA Damage Profile

|       | Other Drugs | UV | Illudin S |
|-------|-------------|----|-----------|
| XP-A  | +           | +  | +         |
| XP-B  | 0           | +  | +         |
| XP-C  | +           | +  | 0         |
| XP-D  | 0           | +  | +         |
| XP-E  | +           | +  | 0         |
| XP-F  | +           | +  | +         |
| CS-A  | +/-         | +  | ++        |
| CS-B  | +/-         | +  | ++        |
| ERCC1 | +           | +  | +         |
| ERCC5 | +           | +  | +         |

Indicates novel mechanism of action versus other chemotherapeutic agents

Figure 7

| Mechanism | Resistance to Irofulven |
|---|---|
| Gp170/MDR1 | No |
| Gp180/MRP | No |
| Topoisomerase I | No |
| Topoisomerase II | No |
| LRP(vault) | No |
| Thiol Content | No |
| DNA repair (?) | No |
| Myc expression | No |
| Bcl-2 expression | No |
| BRCA status | No |
| p53 status | No |
| p21 status | No |

Figure 14A
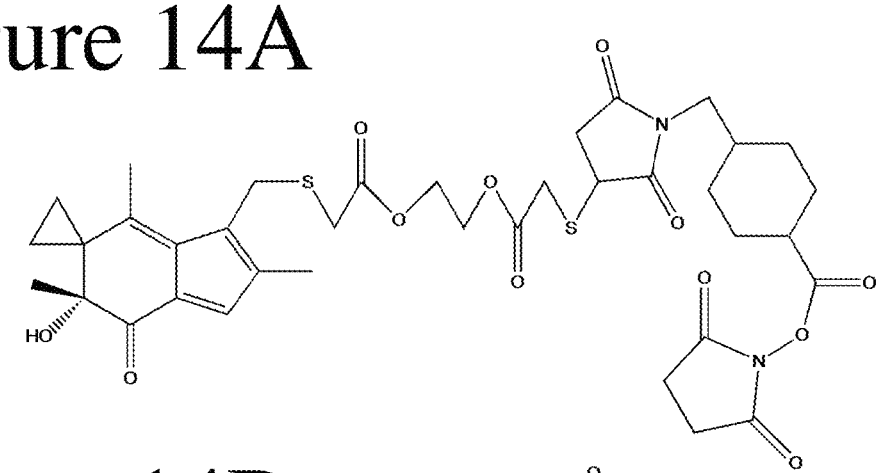
Figure 14B
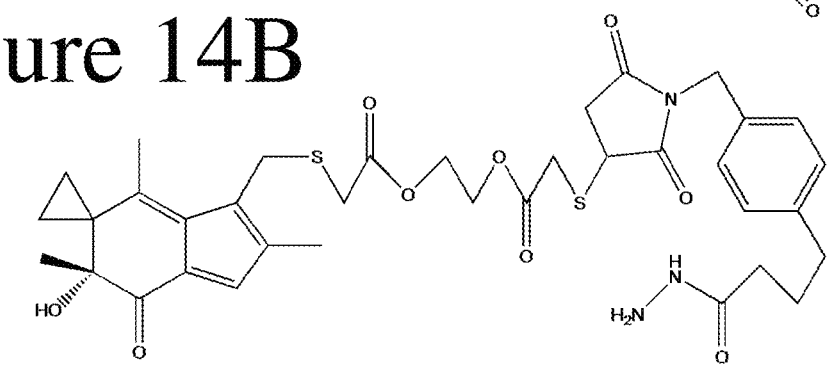
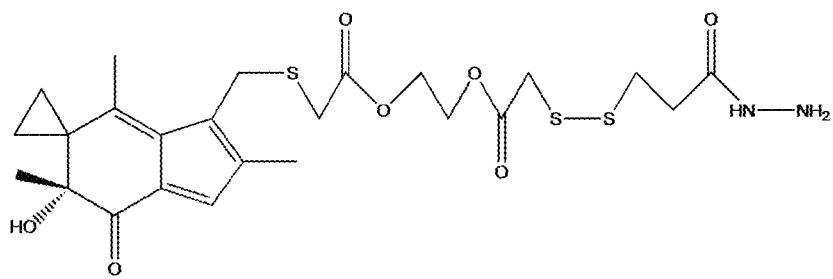
Figure 14C

Figure 21A
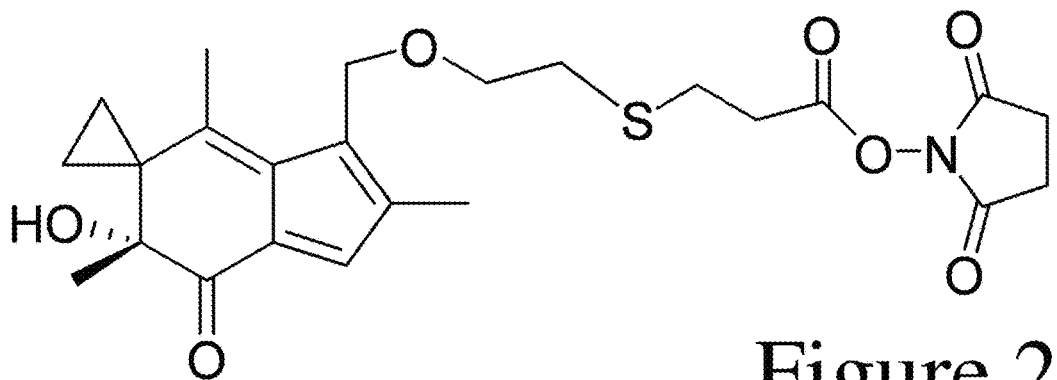
Figure 21B
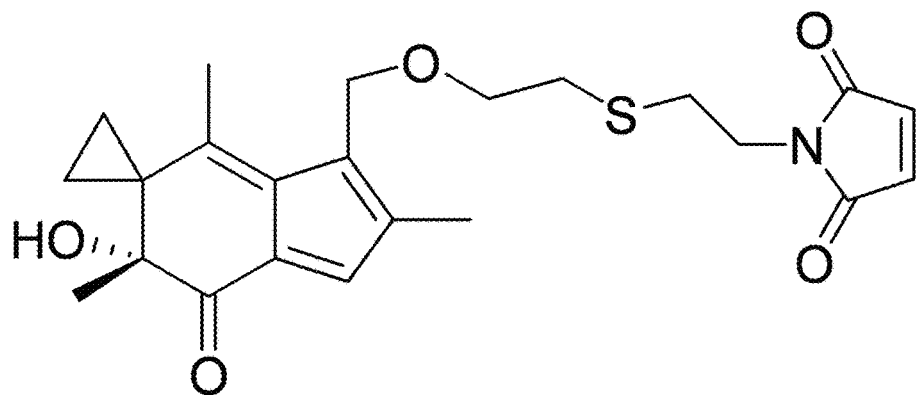
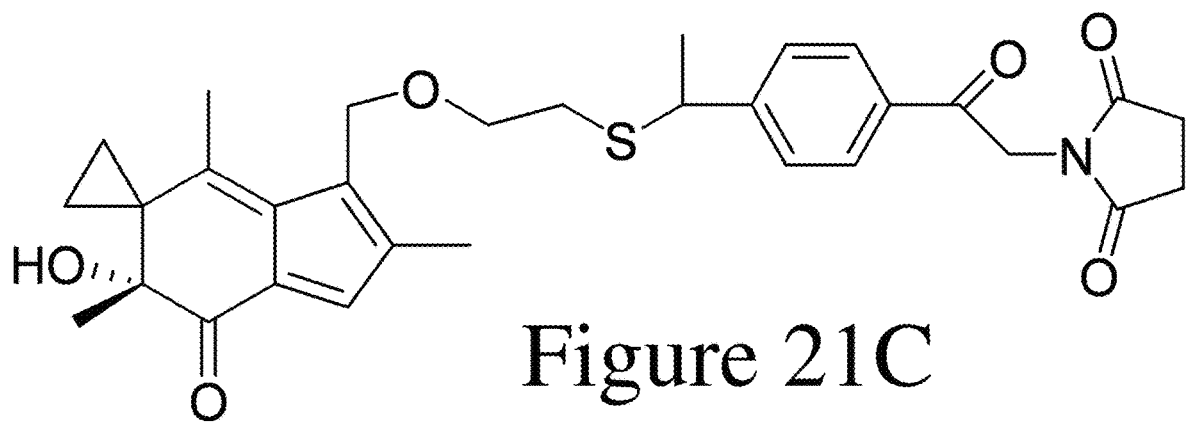
Figure 21C

AFFINITY MEDICANT CONJUGATES

PRIORITY CLAIM

This application is a continuation in part of and claims priority to (1) U.S. patent application Ser. No. 15/986,727 entitled "AFFINITY MEDICANT CONJUGATES", inventor: Michael J. Kelner, filed May 22, 2018 which is a continuation of (2) U.S. patent application Ser. No. 15/201, 301 entitled "AFFINITY MEDICANT CONJUGATES", inventor: Michael J. Kelner, filed Jul. 1, 2016, which issued as U.S. Pat. No. 9,980,926 on May 29, 2018 which is a continuation of (3) U.S. patent application Ser. No. 14/684, 218 entitled "AFFINITY MEDICANT CONJUGATES", inventor: Michael J. Kelner, filed Apr. 10, 2015, which issued as U.S. Pat. No. 9,381,178 on Jul. 5, 2016 and which claims priority to (4) the U.S. Provisional Application No. 61/978,195 entitled "AFFINITY MEDICANT CONJUGATES", inventor: Michael J. Kelner filed Apr. 10, 2014, which applications (1)-(4) we herein expressly incorporated by reference in their entireties and for all purposes.

REFERENCE TO A "SEQUENCE LISTING," A TABLE OR A COMPUTER PROGRAM LISTING APPENDIX SUBMITTED AS AN ASCII TEXT FILE

The Sequence Listing written in file MKEL-01047US5.ST25.TXT, created Aug. 13, 2020, 845,776 bytes, machine format IBM-PC, MS-Windows operating system, is hereby incorporated by reference.

TECHNICAL FIELD

The present invention relates to compositions and methods for treating target molecules including cell populations with an affinity medicant conjugate such as an antibody drug conjugate.

BACKGROUND

The present invention is directed to Affinity Medicant Conjugates (AMC) including acylfulvene, Illudin and Syn-Illudin based conjugates, Affinity Medicant Linker Conjugates (AMLC), antibody-drug cojugates (ADC) and medicant-linker (ML) compounds, as well as to compositions of the same, and to methods for their use in treating cancer, an autoimmune to methods of using Ligand Linker Medicant (LLM) conjugates and ML compounds in vitro, in situ, and in vivo for the detection, diagnosis or treatment of cells and associated pathological conditions.

SUMMARY OF INVENTION

There exists a continuing need for delivery of chemotherapeutic agents for which tumors do not have a medicant resistant phenotype and which inhibit tumor growth, especially solid tumor growth, and which have an adequate therapeutic index to be effective for in vivo treatment. The antibody medicant conjugates of the present invention can have utility in a wide range of therapeutic applications in humans as well as in animals in general. For example, such therapeutic applications can include: cancer, adenocarcinoma, carcinoma, breast cancer, prostate cancer, ovarian cancer, endometrial cancer, neuroendocrine tumors, infertility, polycystic ovary syndrome, endometriosis, and precocious puberty. For example, veterinary and agricultural applications can include treatment of cancer, adenocarcinoma, carcinoma, ovarian cancer, endometrial cancer, neuroendocrine tumors, and endometriosis in farmyard and/or companion animals.

The methods of this invention include administration of an effective amount of an antibody medicant conjugate, preferably in the form of a pharmaceutical composition, to an animal in need thereof. In a further embodiment, pharmaceutical compositions are disclosed containing an antibody medicant conjugate of the present invention in combination with a pharmaceutically acceptable carrier.

In various embodiments of the present invention, an affinity medicant conjugate is made up of an antibody 1110 linked to an illudin1 moiety 1301. Various embodiments of the invention, are directed to the methods for the preparation, use, and to pharmaceutical compositions containing an illudin1 moiety 1301 linked to an antibody 1110 to form an antibody medicant conjugate (AMC). In various embodiments the compounds of the present invention, the AMC can have the general formula shown in FIG. 3A, where the antibody 1110 is bound to a linker 1200 which is bound to an illudin1 moiety 1301. In other various embodiments of the present invention, the compounds of the present AMC invention can have the general formula shown in FIG. 3B, where a growth factor 1120 is bound to a linker 1200 which is bound to an illudin1 moiety 1301. In various embodiments the compounds of the present invention include stercoisomers, solvates, and pharmaceutically acceptable salts thereof, where the linker 1200 is as defined in Table X, and the illudin1 1301 is as defined below in Table X1.

In various embodiment of the present invention, an antibody linked to an acylfulvene moiety acts as a ligand for an Epidermal Growth Factor (EGF) receptor (EGF-R) (SEQ. ID. 143) and directs the acylfulvene to cell populations expressing the EGF-R. These compounds are useful as a means of treating cell populations expressing the EGF-R. In an embodiment of the present invention, these compounds are useful in treatment of tumors in which the EGF-R is over expressed. In an embodiment of the present invention, these compounds are useful in treatment of cells in which the EGF-R acts as a marker. In various embodiment of the present invention, these compounds are useful in agricultural applications in which the EGF-R acts as a marker of cell populations involved in agricultural production. In various embodiment of the present invention, these compounds are useful in veterinary medicine in which the EGF-R acts as a marker of cell populations involved in pet reproduction. In various embodiments of the present invention, pharmaceutical compositions comprising these compounds are used in the treatment of tumors in which the EGF-R is involved. In various embodiments of the present invention, methods of using the pharmaceutical compositions comprise these compounds to treat tumors in which the GH-R is involved.

BRIEF DESCRIPTION OF THE DRAWINGS

This invention is described with respect to specific embodiments thereof. Additional features can be appreciated from the Figures in which:

FIG. 2P shows the structure of azlactone acylfulvene medicant moiety (where $R_2$=H, $CH_3$, $CH_2OH$), according to an embodiment of the invention; FIG. 2Q shows the structure of azlactone secondary hydroxyl illudin2 linkage medicant moiety (where $R_2$=H, CH, $CH_2OH$), according to an embodiment of the invention; FIG. 2R shows the structure of azlactone primary hydroxyl linkage illudin2 medicant moiety (where $R_2$=H, $CH_N$, $CH_2OH$), according to an embodiment of the invention.

FIG. 4 shows the selective toxicity of an acylfulvene analog, according to various embodiments of the invention;

FIG. 5 shows the unique deoxynucleic acid (DNA) damage profile of an acylfulvene analog, according to an embodiment of the invention;

FIG. 7 shows the multidrug resistance studies of an acylfulvene analog, according to an embodiment of the invention;

FIG. 14A shows the structure of the analog 051 attached via the sulfhydryl group using SMCC linking reagent according to an embodiment of the invention; FIG. 14B shows the structure of the analog 051 attached via the sulfhydryl group using MPBH linking reagent according to an embodiment of the invention; FIG. 14C shows the structure of the analog 051 attached via the sulfhydryl group using PDPH linking reagent according to an embodiment of the invention;

FIG. 21A shows analog 20 linked to DSP according to an embodiment of the invention;

FIG. 21B shows analog 20 linked to DTME according to an embodiment of the invention; and FIG. 21C shows analog 20 linked to SMPT according to an embodiment of the invention.

DETAILED DESCRIPTION OF THE INVENTION

Definitions

Figure 1:
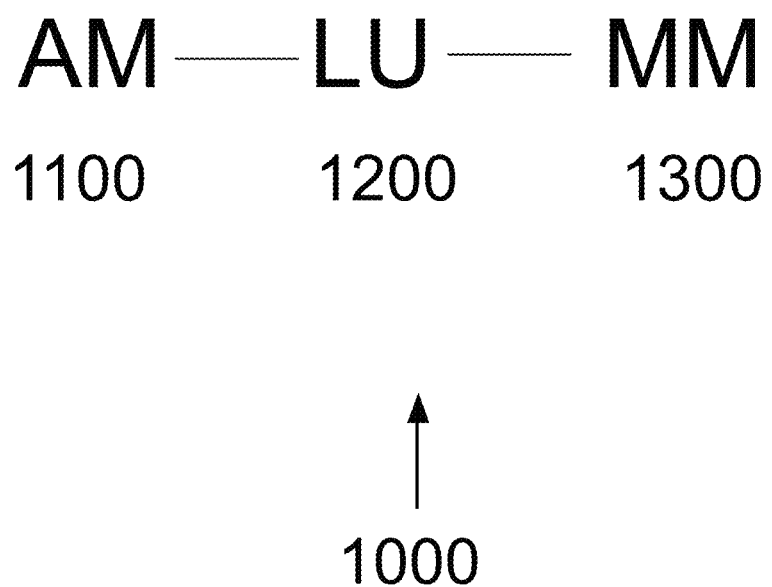
FIG. 1 shows a schematic description of the Affinity Medicant Conjugate (AMC) 1000, where an Affinity Moiety (AM) 1100 is bound to a medicant moiety (MM) 1300 via a Linker Unit (LU) 1200, according to various embodiments of the invention.

As used herein, the term "receptor for a biologically active polypeptide" means a receptor which can bind a biologically active peptide conjugate.

As used herein, the term "cell population" is used to describe a set or subset of cells expressing a receptor.

As used herein, the terms "analog". "medicant" and "medicant moiety" are used interchangeably and comprise synthetic and naturally occurring drugs, toxins, nutraceuticals and other cytoactive, anti-inflammatory and bioactive molecules including Doxorubicin (Immunomedics), auristatins E (Seattle Genetics), suristatins F (Celdex), monomethyl auristatin E (MMAE) (Amgen), monomethyl auristatin F (MMAF) (Astelles), maytanasines (Immunogen), DMI (Biotest), DM4 (Amgen), calicheamicin (CellTech), irinotecan, folate, SN38 (Immunomedics), Pyrrolobenzodiazepines (Seattle Genetics), MGBA a duocarmycin derivative (Medarex), thalidomides, taxanes, penicillins, Trastuzumab emtansine (Genentech for Breast cancer uses maytanasine derive DM-1). A medicant includes analogs 192, 197, 272, 273, 274, 290, 291, 292, 293 (i.e., acylfulvenes linked to thalidomide, cephalosporin or colchicines derivatives). Some of the above analogs are stand alone drugs, but can be used as a medicant moiety in an affinity drug conjugate according to various embodiments of the invention.

As used herein, the phrase "peptide receptor" includes peptide hormone receptors, protein hormone receptors, chemotactic receptors and chemokine receptors As used herein, the term "receptor" includes growth factor receptors, peptide hormone receptors, peptide receptors, steroid hormone receptors, steroid receptors and lipid receptors.

As used herein, phrase "affinity medicant conjugate" is an Affinity Moiety covalendy bound to a medicant moiety, and includes antibody medicant conjugates, where the antibody is directed to a specific receptor. As used herein the phrase 'Affinity Moiety' includes antibodies, antibody fragments, peptides, proteins, growth factors, steroids, and lipids, where the antibodies, antibody fragments, peptides, proteins, growth factors, steroids, folate or lipids have an affinity for a specific receptor, receptors, is processed by an enzyme to produce a ligand that has an affinity for a specific receptor or otherwise directs the Affinity Moiety to a specific subset of cells. A 'medicant moiety' includes a group bound to an Affinity Moiety, which when released acts as a medicant.

As used herein, the term "Affinity Moiety" (AM) is used to describe a chemical group or molecule that can bind a receptor or proteins. An AM is understood to have a minimum binding affinity greater than approximately $1 \times 1^{-3}$ M affinity. As used herein, the term AM includes "ligands", "ligand moieties", "affinity unit" and an AM modified to include a linker. As used herein, the phrase "an affinity moiety directed to a peptide receptor" is used to describe a molecule or a portion of a molecule which has a binding affinity to the peptide receptor greater than approximately $1 \times 10^{-10}$ M. In this range approximately means $1 \times 10^{-9}$ M to $1 \times 10^{-11}$ M. In an embodiment of the invention, an AM directed to a peptide receptor has a binding affinity to the peptide receptor greater than approximately $1 \times 10^{-12}$ M. In this range approximately means $1 \times 10^{-11}$ M to $1 \times 10^{-13}$ M.

As used herein, the term "linker" is used to describe one or more covalently bonded groups of atoms that are covalently bonded to a medicant moiety and an AM. For example a linker can be covalently bound to both an acylfulvene moiety and to an antibody or other ligand moiety with an affinity for a receptor.

As used herein, the term "non releasable linker" is used to describe a linker covalently bound to an AM and a medicant moiety in which the AM and the medicant moiety remain covalently bound to the linker after internalization and exposure to both reducing and acidic environments of vesicles within the cell. As used herein, the term "membrane permeability" is used to describe a compound comprising a linker covalently bound to an AM and an acylfulvene moiety, where the compound can diffuse across membranes within the cell.

As used herein, the term "transmembrane receptor" means a protein that spans the plasma membrane of a cell with the extracellular domain of the protein having the ability to bind an AM and the intracellular domain having an activity such as activation of G protein signaling which is induced upon the AM binding.

As used herein, the term "seven transmembrane receptor" is a transmembrane receptor including a transmembrane domain where the protein spans the cell membrane in seven (7) regions.

As used herein, the term "G-protein coupled receptor" means a seven transmembrane domain receptor which transduces a biological signal via U-protein coupling.

As used herein, the term "conjugated" or "conjugate" means a chemical compound that is formed by joining two or more compounds with one or more chemical bonds or linkers. In an embodiment of the invention, an antibody and a medicant form a conjugate.

As used herein, the term "antibody" herein is used in the broadest sense and specifically covers intact antibodies, monoclonal antibodies, polyclonal antibodies, mono-specific antibodies, multi-specific antibodies (e.g., bi-specific antibodies), and antibody fragments that exhibit the desired biological activity, including those antibodies directed against Alk, Alk fusion proteins, CD 2 (SEQ. ID. 001), CD3epsilon (SEQ. ID. 002), CD5 (SEQ. ID. 003), CD7 (SEQ. ID. 004), CD19 (SEQ. ID. 005), CD20 (SEQ. ID. 006), CD22 (SEQ. ID. 007), CD25 (SEQ. ID. 008), CD30 (SEQ. ID. 009), CD33 (SEQ. ID. 010), CD37 (SEQ. ID. 011), CD44 (SEQ. ID. 012), CD44v6 (SEQ. ID. 013), CD56 (SEQ. ID. 014), CD70 (SEQ. ID. 015), CD74 (SEQ. ID. 016), CD79 (SEQ. ID. 017), CD79b (SEQ. ID. 018), CD 80 (SEQ. ID. 019), CD 86 (SEQ. ID. 020), CD138 (syndecan 1) (SEQ. ID. 021), CAIX (SEQ. ID. 022), Integrin alphaV-beta 3 (SEQ. ID. 023), EphA2 (SEQ. ID. 024), Cryptol (SEQ. ID. 025), CanAg (SEQ. ID. 026), ENPP3 (SEQ. ID. 027), Nectin-4 (SEQ. ID. 028), Mesotbelin (SEQ. ID. 029), Lewis Y (SEQ. ID. 030), EGFRvIII (SEQ. ID. 031), SLC44A4 (SEQ. ID. 032), EBTR (endothelin) (SEQ. ID. 033), crbB2/neu/HER2 (SEQ. ID. 034), Transferrin receptor (SEQ. ID. 035), 55 kDa breast cancer antigen, 72 kDa TAA, GPNMB (osteoactivin) (SEQ. ID. 038), CA-IX (SEQ. ID. 039), CEA (CD66e) (SEQ. ID. 040), CEACAM5 (SEQ. ID. 041), PSMA (SEQ. ID. 042), CA125 (MUC16) (SEQ. ID. 043), Muc1 (CA6) (SEQ. ID. 044), Melanoma glycoprotein NMB (SEQ. ID. 045), IL-2R (SEQ. ID. 166 and 046), IL13R (SEQ. ID. 047), TACSTD2 (TROP2 or EGP1) (SEQ. ID. 048), Folate receptor 1 (SEQ. ID. 049), Mucin 16 (SEQ. ID. 050), Endothelin receptor ETB (SEQ. ID. 051), STEAP1 (SEQ. ID. 052), SLC44A4 (AGS-5) (SEQ. ID. 053), AGS-16 (SEQ. ID. 054), and Guanylyl cyclase C (SEQ. ID. 055). An intact antibody has primarily two regions: a variable region and a constant region. The variable region binds to and interacts with a target antigen. The variable region includes a complementary determinusng region (CDR) that recognizes and binds to a specific binding site on a particular antigen. The constant region may be recognized by and interact with the immune system. An antibody can be of any type or class (e.g., IgG, IE, IgM, IgD, and IgA) or subclass (e.g., IgG1, IgG2, IgG3, IgG4, IgA1 and IgA2). The antibody can be derived from any suitable species. In some embodiments, the antibody is of human or murine origin. An antibody can be, for example, human, humanized or chimeric.

As used herein, the terms "specifically binds" and "specific binding" refer to antibody binding to a predetermined antigen. Typically, the antibody binds with an affinity of at least about $1\times10^7$ M, and binds to the predetermined antigen with an affinity that is at least two-fold greater than its affinity for binding to a non-specific antigen (e.g., Bovine Serum Albumin, casein) other than the predetermined antigen or a closely-related antigen.

As used herein, "isolated" means separated from other components of (a) a natural source, such as a plant or animal cell or cell culture, or (b) a synthetic organic chemical reaction mixture. As used herein, "purified" means that when isolated, the isolate contains at least 95%, and in another aspect at least 98%, of a compound (e.g., a conjugate) by weight of the isolate.

As used herein, the term "therapeutically effective amount" refers to an amount of a medicant effective to treat a disease or disorder in a mammal. In the case of cancer, the therapeutically effective amount of the medicant may reduce the number of cancer cells; reduce the tumor size; inhibit (i.e., slow to some extent and preferably stop) cancer cell infiltration into peripheral organs; inhibit (i.e., slow to some extent and preferably stop) tumor metastasis; inhibit, to some extent, tumor growth; and/or relieve to some extent one or more of the symptoms associated with the cancer. To the extent the medicant may inhibit the growth of and/or kill existing cancer cells, it may be cytostatic and/or cytotoxic. For cancer therapy, efficacy can, for example, be measured by assessing the time to disease progression (TTP) and/or determining the response rate (RR).

As used herein, the term "substantial amount" refers to a majority, i.e. greater than approximately fifty percent (50%) of a population, of a mixture or a sample. In this range approximately means plus or minus ten percent (10%).

As used herein, the term "intracellular metabolite" refers to a compound resulting from a metabolic process or reaction inside a cell on an Affinity Medicant Linker conjugate (e.g., an Antibody Drug Conjugate (AMC)). The metabolic process or reaction may be an enzymatic process such as proteolytic cleavage of a peptide linker of the AMC. Intracellular metabolites include, but are not limited to, antibodies and free medicant which have undergone intracellular cleavage after entry, diffusion, uptake or transport into a cell.

As used herein, the terms "intracellularly cleaved" and "intracellular cleavage" refer to a metabolic process or reaction inside a cell on an Affinity Medicant Linker conjugate (e.g., an Antibody Medicant conjugate (AMC) or the like), whereby the covalent attachment, e.g., the linker, between the Medicant moiety (M) and the Affinity unit (e.g., an antibody (Ab)) is broken, resulting in the free Medicant, or other metabolite of the conjugate dissociated from the antibody inside the cell. The cleaved moieties of the Affinity Medicant Linker conjugate are thus intracellular metabolites.

As used herein, the term "bioavailability" refers to the systemic availability (i.e., blood/plasma levels) of a given amount of a medicant administered to a patient. Bioavailability is an absolute term that indicates measurement of both the time (rate) and total amount (extent) of medicant that reaches the general circulation from an administered dosage form.

As used herein, the term "cytotoxic activity" refers to a cell-killing, a cytostatic or an anti-proliferative effect of an Affinity Medicant Linker conjugate or an intracellular metabolite of an Affinity Medicant Linker conjugate. Cytotoxic activity may be expressed as the $IC_{50}$ value, which is the concentration (molar or mass) per unit volume at which half the cells survive.

As used herein, the term "cytotoxic agent" as used herein refers to a substance that inhibits or inhibits the function of cells and/or causes destruction of cells. The term is intended to include radioactive isotopes (e.g., $^{211}At$, $^{131}I$, $^{125}I$, $^{90}Y$, $^{186}Re$, $^{188}Re$, $^{153}Sm$, $^{212}Bi$, $^{32}P$, $^{60}C$, and radioactive isotopes of Lu), chemotherapeutic agents, and toxins such as small molecule toxins or enzymatically active toxins of bacterial, fungal, plant or animal origin, including synthetic analogs and derivatives thereof. In one aspect, the term does not include a radioactive isotope(s).

As used herein, an example of a "patient" includes, but is not limited to, a human, rat, mouse, guinea pig, monkey, pig, goat, cow, horse, dog, cat, bird and fowl. In an exemplary embodiment, the patient is a human.

As used herein, the terms "treat" or "treatment," unless otherwise indicated by context, refer to therapeutic treatment and prophylactic measures to prevent relapse, wherein the object is to inhibit or slow down (lessen) an undesired physiological change or disorder, such as the development or spread of cancer. For purposes of this invention, beneficial or desired clinical results include, but are not limited to, alleviation of symptoms, diminishment of extent of disease, stabilized (i.e., not worsening) state of disease, delay or slowing of disease progression, amelioration or palliation of the disease state, and remission (whether partial or total), whether detectable or undetectable. "Treatment" can also mean prolonging survival as compared to expected survival if not receiving treatment. Those in need of treatment include those already having the condition or disorder as well as those prone to have the condition or disorder.

As used herein, in the context of cancer, the term "treating" includes any or all of inhibiting growth of tumor cells, cancer cells, or of a tumor; inhibiting replication of tumor cells or cancer cells, lessening of overall tumor burden or decreasing the number of cancerous cells, and ameliorating one or more symptoms associated with the disease.

As used herein, the term "chiral" refers to molecules which have the property of non-superimposability of the mirror image partner, while the term "achiral" refers to molecules which are superimposable on their mirror image partner.

As used herein, the term "stereoisomers" refers to compounds which have identical chemical constitution, but differ with regard to the arrangement of the atoms or groups in space.

As used herein, "diastereomer" refers to a stereoisomer with two or more centers of chirality and whose molecules are not mirror images of one another. Diastereomers have different physical properties, e.g., melting points, boiling points, spectral properties, and reactivities. Mixtures of diastereomers may separate under high resolution analytical procedures such as electrophoresis and chromatography.

The abbreviations used herein have their conventional meaning within the chemical and biological arts. The chemical structures and formulae set forth herein are constructed according to the standard rules of chemical valency known in the chemical arts.

Where substituent groups are specified by their conventional chemical formulae, written from left to right, they equally encompass the chemically identical substituents that would result from writing the structure from right to left, e.g., —$CH_2O$— is equivalent to —$OCH_2$—.

The term "alkyl," by itself or as part of another substituent, means, unless otherwise stated, a straight (i.e., unbranched) or branched chain, or combination thereof, which may be fully saturated, mono- or polyunsaturated and can include di- and multivalent radicals, having the number of carbon atoms designated (i.e., $C_1$-$C_{10}$ means one to ten carbons). Examples of saturated hydrocarbon radicals include, but are not limited to, groups such as methyl, ethyl, n-propyl, isopropyl, n-butyl, t-butyl, isobutyl, sec-butyl, (cyclohexyl)methyl, homologs and isomers of, for example, n-pentyl, n-hexyl, n-heptyl, n-octyl, and the like. An unsaturated alkyl group is one having one or more double bonds or triple bonds. Examples of unsaturated alkyl groups include, but are not limited to, vinyl, 2-propenyl, crotyl, 2-isopentenyl, 2-(butadienyl), 2,4-pentadienyl, 3-(1,4-pentadienyl), ethynyl, 1- and 3-propynyl, 3-butynyl, and the higher homologs and isomers. An alkoxy is an alkyl attached to the remainder of the molecule via an oxygen linker (—O—).

The term "alkylene," by itself or as part of another substituent, means, unless otherwise stated, a divalent radical derived from an alkyl, as exemplified, but not limited by, —$CH_2CH_2CH_2CH_2$—. Typically, an alkyl (or alkylene) group will have from 1 to 24 carbon atoms, with those groups having 10 or fewer carbon atoms being preferred in the present invention. A "lower alkyl" or "lower alkylene" is a shorter chain alkyl or alkylene group, generally having eight or fewer carbon atoms.

The term "heteroalkyl," by itself or in combination with another term, means, unless otherwise stated, a stable straight or branched chain, or combinations thereof, consisting of at least one carbon atom and at least one heteroatom selected from the group consisting of O, N, P, Si, and S, and wherein the nitrogen and sulfur atoms may optionally be oxidized, and the nitrogen heteroatom may optionally be quaternized. The heteroatom(s) O, N, P, S, and Si may be placed at any interior position of the heteroalkyl group or at the position at which the alkyl group is attached to the remainder of the molecule. Examples include, but are not limited to: —$CH_2CH_2$—O—$CH_3$, —$CH_2$—$CH_2$—NH—$CH_3$, —$CH_2CH_2$—N($CH_3$)—$CH_3$, —$CH_2$—S—$CH_2$—$CH_3$, —$CH_2$—$CH_2$, —S(O)—$CH_3$, —$CH_2$—$CH_2$—S(O)$_2$—$CH_3$, —CH=CH—O—$CH_3$, —Si($CH_3$)$_3$, —$CH_2$—CH=N—$OCH_3$, —CH=CH—N($CH_3$)—$CH_3$, —O—$CH_3$, —O—$CH_2$—$CH_3$, and —CN. Up to two heteroatoms may be consecutive, such as, for example, —$CH_2$—NH—$OCH_3$.

Similarly, the term "heteroalkylene," by itself or as part of another substituent, means, unless otherwise stated, a divalent radical derived from heteroalkyl, as exemplified, but not limited by, —$CH_2$—$CH_2$—S—$CH_2$—$CH_2$— and —$CH_2$—S—$CH_2$—$CH_2$—NH—$CH_2$—. For heteroalkylene groups, heteroatoms can also occupy either or both of the chain termini (e.g., alkyleneoxy, alkylenedioxy, alkyleneamino, alkylenediamino, and the like). Still further, for alkylene and heteroalkylene linking groups, no orientation of the linking group is implied by the direction in which the formula of the linking group is written. For example, the formula —C(O)$_2$R'— represents both —C(O)$_2$R'— and —R'C(O)$_2$—. As described above, heteroalkyl groups, as used herein, include those groups that are attached to the remainder of the molecule through a heteroatom, such as —C(O)R', —C(O)NR', —NR'R", —OR', —SR', and/or —SO$_2$R'. Where "heteroalkyl" is recited, followed by recitations of specific heteroalkyl groups, such as —NR'R" or the like, it will be understood that the terms heteroalkyl and —NR'R" are not redundant or mutually exclusive. Rather, the specific heteroalkyl groups are recited to add clarity. Thus, the term "heteroalkyl" should not be interpreted herein as excluding specific heteroalkyl groups, such as —NR'R" or the like.

The term "cycloalkyl" and "heterocycloalkyl," by themselves or in combination with other terms, mean, unless otherwise stated, cyclic versions of "alkyl" and "heteroalkyl," respectively. Additionally, for heterocycloalkyl, a heteroatom can occupy the position at which the heterocycle is attached to the remainder of the molecule. Examples of cycloalkyl include, but are not limited to, cyclopropyl, cyclobutyl, cyclopentyl, cyclohexyl, 1-cyclohexenyl, 3-cyclohexenyl, cycloheptyl, and the like. Examples of heterocycloalkyl include, but are not limited to, 1-(1,2,5,6-tetrahydropyridyl), 1-piperidinyl, 2-piperidinyl, 3-piperidinyl, 4-morpholinyl, 3-morpholinyl, tetrahydrofuran-2-yl, tetrahydrofuran-3-yl, tetrahydrothien-2-yl, tetrahydrothien-3-yl, 1-piperazinyl, 2-piperazinyl, and the like. A "cycloalkylene" and a "heterocycloalkylene," alone or as part of another substituent, means a divalent radical derived from a cycloalkyl and heterocycloalkyl, respectively.

The terms "halo" or "halogen," by themselves or as part of another substituent, mean, unless otherwise stated, a fluorine, chlorine, bromine, or iodine atom. Additionally, terms such as "haloalkyl" are meant to include monohaloalkyl and polyhaloalkyl. For example, the term "halo($C_1$-$C_4$)alkyl" includes, but is not limited to, fluoromethyl, difluoromethyl, trifluoromethyl, 2,2,2-trifluoroethyl, 4-chlorobutyl, and 3-bromopropyl.

The term "acyl" means, unless otherwise stated, —C(O)R where R is a substituted or unsubstituted alkyl, substituted or unsubstituted cycloalkyl, substituted or unsubstituted heteroalkyl, substituted or unsubstituted heterocycloalkyl, substituted or unsubstituted aryl, or substituted or unsubstituted heteroaryl.

The term "aryl" means, unless otherwise stated, a polyunsaturated, aromatic, hydrocarbon substituent, which can be a single ring or multiple rings (preferably from 1 to 3 rings) that are fused together (i.e., a fused ring aryl) or linked covalently. A fused ring aryl refers to multiple rings fused together wherein at least one of the fused rings is an aryl ring. The term "heteroaryl" refers to aryl groups (or rings) that contain from one to four heteroatoms selected from N, O, and S, wherein the nitrogen and sulfur atoms are optionally oxidized, and the nitrogen atom(s) are optionally quaternized. Thus, the term "heteroaryl" includes fused ring heteroaryl groups (i.e., multiple rings fused together wherein at least one of the fused rings is a heteroaromatic ring). A 5,6-fused ring heteroarylene refers to two rings fused together, wherein one ring has 5 members and the other ring has 6 members, and wherein at least one ring is a heteroaryl ring. Likewise, a 6,6-fused ring heteroarylene refers to two rings fused together, wherein one ring has 6 members and the other ring has 6 members, and wherein at least one ring is a heteroaryl ring. And a 6,5-fused ring heteroarylene refers to two rings fused together, wherein one ring has 6 members and the other ring has 5 members, and wherein at least one ring is a heteroaryl ring. A heteroaryl group can be attached to the remainder of the molecule through a carbon or heteroatom. Non-limiting examples of aryl and heteroaryl groups include phenyl, 1-naphthyl, 2-naphthyl, 4-biphenyl, 1-pyrrolyl, 2-pyrrolyl. 3-pyrrolyl, 3-pyrazolyl, 2-imidazolyl, 4-imidazolyl, pyrazinyl, 2-oxazolyl, 4-oxazolyl, 2-phenyl-4-oxazolyl, 5-oxazolyl, 3-isoxazolyl, 4-isoxazolyl, 5-isoxazolyl, 2-thiazolyl, 4-thiazolyl, 5-thiazolyl, 2-furyl, 3-furyl, 2-thienyl, 3-thienyl, 2-pyridyl, 3-pyridyl, 4-pyridyl, 2-pyrimidyl, 4-pyrimidyl, 5-benzothiazolyl, purinyl, 2-benzimidazolyl, 5-indolyl, 1-isoquinolyl, 5-isoquinolyl, 2-quinoxalinyl, 5-quinoxalinyl, 3-quinolyl, and 6-quinolyl. Substituents for each of the above noted aryl and heteroaryl ring systems are selected from the group of acceptable substituents described below. An "arylene" and a "heteroarylene," alone or as part of another substituent, mean a divalent radical derived from an aryl and heteroaryl, respectively.

For brevity, the term "aryl" when used in combination with other terms (e.g., aryloxy, arylthioxy, arylalkyl) includes both aryl and heteroaryl rings as defined above. Thus, the term "arylalkyl" is meant to include those radicals in which an aryl group is attached to an alkyl group (e.g., benzyl, phenethyl, pyridylmethyl, and the like) including those alkyl groups in which a carbon atom (e.g., a methylene group) has been replaced by, for example, an oxygen atom (e.g., phenoxymethyl, 2-pyridyloxymethyl, 3-(1-naphthyloxy)propyl, and the like).

The term "oxo," as used herein, means an oxygen that is double bonded to a carbon atom.

The term "alkylsulfoxide" as used herein, means a moiety having the formula R—S(O)—R', where R and R' are alkyl groups as defined above. R and R' may have a specified number of carbons (e.g., "$C_1$-$C_4$ alkylsulfoxide").

Each of the above terms (e.g., "alkyl," "heteroalkyl," "aryl," and "heteroaryl") includes both substituted and unsubstituted forms of the indicated radical. Preferred substituents for each type of radical are provided below.

Substituents for the alkyl and heteroalkyl radicals (including those groups often referred to as alkylene, alkenyl, heteroalkylene, heteroalkenyl, alkynyl, cycloalkyl, heterocycloalkyl, cycloalkenyl, and heterocycloalkenyl) can be one or more of a variety of groups selected from, but not limited to, —OR', =O, =NR', =N—OR', —NR'R", —SR', -halogen, —SiR'R"R'", —OC(O)R', —C(O)R', —$CO_2$R', —CONR'R", —OC(O)NR'R", —NR"C(O)R', —NR'—C(O)NR"R'", —NR"C(O)$_2$R', —NR—C(NR'R"R'")=NR"", —NR—C(NR'R")=NR'", —S(O)R', —S(O)R', —S(O)$_2$NR'R", —NRSO$_2$R', —CN, and —NO$_2$ in a number ranging from zero to (2m'+1), where m' is the total number of carbon atoms in such radical. R', R", R'", and R"" each preferably independently refer to hydrogen, substituted or unsubstituted heteroalkyl, substituted or unsubstituted cycloalkyl, substituted or unsubstituted heterocycloalkyl, substituted or unsubstituted aryl (e.g., aryl substituted with 1-3 halogens), substituted or unsubstituted alkyl, alkoxy, or thioalkoxy groups, or rylalkyl groups. When a compound of the invention includes more than one R group, for example, each of the R groups is independently selected as are each R', R", R'", and R"" group when more than one of these groups is present. When R' and R" are attached to the same nitrogen atom, they can be combined with the nitrogen atom to form a 4-, 5-, 6-, or 7-membered ring. For example, —NR'R" includes, but is not limited to, 1-pyrrolidinyl and 4-morpholinyl. From the above discussion of substituents, one of skill in the art will understand that the term "alkyl" is meant to include groups including carbon atoms bound to groups other than hydrogen groups, such as haloalkyl (e.g., —$CF_3$ and —$CH_2CF_3$) and acyl (e.g., —C(O)$CH_3$, —C(O)$CF_3$, —C(O)$CH_2OCH_3$, and the like).

Similar to the substituents described for the alkyl radical, substituents for the aryl and heteroaryl groups are varied and are selected from, for example: —OR', —NR'R", —SR', -halogen, —SiR'R"R'", —OC(O)R', —C(O)R', —$CO_2$R', —CONR'R", —OC(O)NR'R", —NR"C(O)R', —NR'—C(O)NR"R'", —NR"C(O)$_2$R', —NR—C(NR'R"R'")=NR"", —NR—C(NR'R")=NR'", —S(O)R', —S(O)R', —S(O)$_2$NR'R", —NRSO$_2$R', —CN, —NO$_2$, —R', —N$_3$, —CH(Ph)$_2$, fluoro($C_1$-$C_4$)alkoxy, and fluoro($C_1$-$C_4$)alkyl, in a number ranging from zero to the total number of open valences on the aromatic ring system; and where R', R", R'", and R"" we preferably independently selected from hydrogen, substituted or unsubstituted alkyl, substituted or unsubstituted heteroalkyl, substituted or unsubstituted cycloalkyl, substituted or unsubstituted heterocycloalkyl, substituted or unsubstituted aryl, and substituted or unsubstituted heteroaryl. When a compound of the invention includes more than one R group, for example, each of the R groups is independently selected as are each R', R", R'", and R"" groups when more than one of these groups is present.

Two or more substituents may optionally be joined to form aryl, heteroaryl, cycloalkyl, or heterocycloalkyl groups. Such so-called ring-forming substituents are typically, though not necessarily, found attached to a cyclic base structure. In one embodiment, the ring-forming substituents ae attached to adjacent members of the base structure. For example, two ring-forming substituents attached to adjacent members of a cyclic base structure create a fused ring structure. In another embodiment, the ring-forming substituents are attached to a single member of the base structure. For example, two ring-forming substituents attached to a single member of a cyclic base structure create a spirocyclic structure. In yet another embodiment, the ring-forming substituents are attached to non-adjacent members of the base structure.

Two of the substituents on adjacent atoms of the aryl or heteroaryl ring may optionally form a ring of the formula -T-C(O)—(CRR')$_q$—U—, wherein T and U are independently —NR—, —O—, —CRR'—, or a single bond, and q is an integer of from 0 to 3. Alternatively, two of the substituents on adjacent atoms of the aryl or heteroaryl ring may optionally be replaced with a substituent of the formula -A-(CH$_2$)$_r$—B—, wherein A and B are independently —CRR'—, —O—, —NR—, —S—, —S(O)—, —S(O)$_2$—, —S(O)$_2$NR'—, or a single bond, and r is an integer of from 1 to 4. One of the single bonds of the new ring so formed may optionally be replaced with a double bond. Alternatively, two of the substituents on adjacent atoms of the aryl or heteroaryl ring may optionally be replaced with a substituent of the formula —(CRR')$_s$—X'—(C"R'")$_d$—, where s and d are independently integers of from 0 to 3, and X' is —O—, —NR'—, —S—, —S(O)—, —S(O)$_2$—, or —S(O)$_2$NR'—. The substituents R, R', R", and R'" are preferably independently selected from hydrogen, substituted or unsubstituted alkyl, substituted or unsubstituted cycloalkyl, substituted or unsubstituted heterocycloalkyl, substituted or unsubstituted aryl, and substituted or unsubstituted heteroaryl.

As used herein, the terms "heteroatom" or "ring heteroatom" ae meant to include oxygen (O), nitrogen (N), sulfur (S), phosphorus (P), and silicon (Si).

A "substituent group," as used herein, means a group selected from the following moieties: (A) —OH, —NH$_2$, —SH, —CN, —CF$_3$, —NO$_2$, oxo, halogen, unsubstituted alkyl, unsubstituted heteroalkyl, unsubstituted cycloalkyl, unsubstituted heterocycloalkyl, unsubstituted aryl, unsubstituted heteroaryl, and (B) alkyl, heteroalkyl, cycloalkyl, heterocycloalkyl, aryl, and heteroaryl, substituted with at least one substituent selected from: (i) oxo, —OH, —NH$_2$, —SH, —CN, —CF$_3$, —NO$_2$, halogen, unsubstituted alkyl, unsubstituted heteroalkyl, unsubstituted cycloalkyl, unsubstituted heterocycloalkyl, unsubstituted aryl, unsubstituted heteroaryl, and (ii) alkyl, heteroalkyl, cycloalkyl, heterocycloalkyl, aryl, and heteroaryl, substituted with at least one substituent selected from (a) oxo, —OH, —NH$_2$, —SH, —CN, —CF$_3$, —NO$_2$, halogen, unsubstituted alkyl, unsubstituted heteroalkyl, unsubstituted cycloalkyl, unsubstituted heterocycloalkyl, unsubstituted aryl, unsubstituted heteroaryl, and (b) alkyl, heteroalkyl, cycloalkyl, heterocycloalkyl, aryl, or heteroaryl, substituted with at least one substituent selected from: oxo, —OH, —NH$_2$, —SH, —CN, —CF$_3$, —NO$_2$, halogen, unsubstituted alkyl, unsubstituted heteroalkyl, unsubstituted cycloalkyl, unsubstituted heterocycloalkyl, unsubstituted aryl, and unsubstituted heteroaryl.

A "size-limited substituent" or "size-limited substituent group," as used herein, means a group selected from all of the substituents described above for a "substituent group," wherein each substituted or unsubstituted alkyl is a substituted or unsubstituted C$_1$-C$_{20}$ alkyl, each substituted or unsubstituted heteroalkyl is a substituted or unsubstituted 2 to 20 membered heteroalkyl, each substituted or unsubstituted cycloalkyl is a substituted or unsubstituted C$_4$-C$_8$ cycloalkyl, and each substituted or unsubstituted heterocycloalkyl is a substituted or unsubstituted 4 to 8 membered heterocycloalkyl.

A "lower substituent" or "lower substituent group," as used herein, means a group selected from all of the substituents described above for a "substituent group," wherein each substituted or unsubstituted alkyl is a substituted or unsubstituted C$_1$-C$_8$ alkyl, each substituted or unsubstituted heteroalkyl is a substituted or unsubstituted 2 to 8 membered heteroalkyl, each substituted or unsubstituted cycloalkyl is a substituted or unsubstituted C$_5$-C$_7$ cycloalkyl, and each substituted or unsubstituted heterocycloalkyl is a substituted or unsubstituted 5 to 7 membered heterocycloalkyl.

The term "pharmaceutically acceptable salts" is meant to include salts of the active compounds that are prepared with relatively nontoxic acids or bases, depending on the particular substituents found on the compounds described herein. When compounds of the present invention contain relatively acidic functionalities, base addition salts can be obtained by contacting the neutral form of such compounds with a sufficient amount of the desired base, either neat or in a suitable inert solvent. Examples of pharmaceutically acceptable base addition salts include sodium, potassium, calcium, ammonium, organic amino, or magnesium salt, or a similar salt. When compounds of the present invention contain relatively basic functionalities, acid addition salts can be obtained by contacting the neutral form of such compounds with a sufficient amount of the desired acid, either neat or in a suitable inert solvent. Examples of pharmaceutically acceptable acid addition salts include those derived from inorganic acids like hydrochloric, hydrobromic, nitric, carbonic, moaohydrogencarbonic, phosphoric, monohydrogenphosphoric, dihydrogenphosphoric, sulfuric, monohydrogensulfuric, hydriodic, or phosphorous acids and the like, as well as the salts derived from relatively nontoxic organic acids like acetic, propionic, isobutyric, maleic, malonic, benzoic, succinic, suberic, fumaric, lactic, mandelic, phthalic, benzenesulfonic, p-tolylsulfonic, citric, tartaric, oxalic, methanesulfonic, and the like. Also included are salts of amino acids such as arginate, and salts of organic acids like glucuronic or galacturonic acids. Certain specific compounds of the present invention contain both basic and acidic functionalities that allow the compounds to be converted into either base or acid addition salts.

Thus, the compounds of the present invention may exist as salts, such as with pharmaceutically acceptable acids. The present invention includes such salts. Examples of such salts include hydrochlorides, hydrobromides, sulfates, methanesulfonates, nitrates, maleates, acetates, citrates, fumarates, tartrates (e.g., (+)-tartrates, (−)-tartrates, or mixtures thereof including racemic mixtures), succinates, benzoates, and salts with amino acids such as glutamic acid. These salts may be prepared by methods known to those skilled in the ar.

The neutral forms of the compounds are preferably regenerated by contacting the salt with a base or acid and isolating the parent compound in the conventional manner. The parent form of the compound differs from the various salt forms in certain physical properties, such as solubility in polar solvents.

In addition to salt forms, the present invention provides compounds in a prodrug form. Prodrugs of the compounds described herein are those compounds that readily undergo chemical changes under physiological conditions to provide the compounds of the present invention. Additionally, prodrugs can be converted to the compounds of the present invention by chemical or biochemical methods in an ex vivo environment. For example, prodrugs can be slowly converted to the compounds of the present invention when placed in a transdermal patch reservoir with a suitable enzyme or chemical reagent.

Certain compounds of the present invention can exist in unsolvated forms as well as solvated forms, including hydrated forms. In general, the solvated forms are equivalent to unsolvated forms and are encompassed within the scope of the present invention. Certain compounds of the present invention may exist in multiple crystalline or amorphous forms. In general, all physical forms are equivalent for the uses contemplated by the present invention and are intended to be within the scope of the present invention.

Certain compounds of the present invention possess asymmetric carbon atoms (optical centers) or double bonds, the racemates, diastereomers, tautomers, geometric isomers, and individual isomers are encompassed within the scope of the present invention. The compounds of the present invention do not include those that are known in the art to be too unstable to synthesize and/or isolate.

The compounds of the present invention may also contain unnatural proportions of atomic isotopes at one or more of the atoms that constitute such compounds. For example, the compounds may be radiolabeled with radioactive isotopes, such as for example tritium ($^3$H), iodine-125 ($^{125}$I), carbon-13 ($^{13}$C), or carbon-14 ($^{14}$C). All isotopic variations of the compounds of the present invention, whether radioactive or not, are encompassed within the scope of the present invention.

Many organic compounds exist in optically active forms, i.e., they have the ability to rotate the plane of plane-polarized light. In describing an optically active compound, the prefixes D and L, or R and S, are used to denote the absolute configuration of the molecule about its chiral center(s). The prefixes d and l or (+) and (−) are employed to designate the sign of rotation of plane-polarized light by the compound, with (−) or l meaning that the compound is levorotatory. A compound prefixed with (+) or d is dextrorotatory. For a given chemical structure, these stereoisomers are identical except that they are mirror images of one another. A specific stereoisomer may also be referred to as an enantiomer, and a mixture of such isomers is often called an enantiomeric mixture. A 50:50 mixture of enantiomers is referred to as a racemic mixture or a racemate, which may occur where there has been no stereoselection or stereospecificity in a chemical reaction or process. The terms "racemic mixture" and "racemate" refer to an equimolar mixture of two enantiomeric species, devoid of optical activity.

As used herein, an amino acid "derivative" includes an amino acid having substitutions or modifications by covalent attachment of a parent amino acid, such as, e.g., by alkylation, glycosylation, acetylation, phosphorylation, and the like. Further included within the definition of "derivative" is, for example, one or more analogs, of an amino acid with substituted linkages, as well as other modifications known in the art.

As used herein, a "natural amino acid" refers to arginine, glutamine, phenylalanine, tyrosine, tryptophan, lysine, glycine, alanine, histidine, serine, proline, glutamic acid, aspartic acid, threonine, cysteine, methionine, leucine, asparagine, isoleucine, and valine, unless otherwise indicated by context.

As used herein, a "protecting group" refers to a moiety that when attached to a reactive group in a molecule masks, reduces or prevents that reactivity. Representative hydroxy protecting groups include acyl groups, benzyl and trityl ethers, tetrahydropyranyl ethers, trialkylsilyl ethers and allyl ethers. Representative amino protecting groups include formyl, acetyl, trifluoroacetyl, benzyl, benzyloxycarbonyl (CBZ), tert-butoxycarbonyl (Boc), trimethyl silyl (TMS), 2-trimethylsilyl-ethanesulfonyl (SES), trityl and substituted trityl groups, allyloxycabonyl, 9-fluorenylmethyloxycarbonyl (FMOC), nitro-veratryloxycarbonyl (NVOC), and the like. Examples of a "hydroxyl protecting group" include, but are not limited to, methoxymethyl ether, 2-methoxyethoxymethyl ether, tetrahydropyranyl ether, benzyl ether, p-methoxybenzyl ether, trimethylsilyl ether, triethylsilyl ether, triisopropyl silyl ether, t-butyldimethyl silyl ether, triphenylmethyl silyl ether, acetate ester, substituted acetate esters, pivaloate, benzoate, methanesulfonate and p-toluenesulfonate.

Abbreviations used include: DMAP=4-dimethylaminopyridine; DCC=N,N'-dicycyclohexylcarbodiimide; ODHBt=3,4,-dihydroxy-4-oxo-1,2,3-benzo-triazine-3-yl ester; NMM=N-methylmorpholin; EDC=1-(3-dimethylaminopropyl)-3-ethylcarbodiimide hydrochloride; DIAD=diisopropyl azodicarboxylate; DEAD=diethyl azodicarboxylate; and DIPC=N,N'-diisopropylcarbodiimide.

As used herein, a "leaving group" refers to a functional group that can be substituted by another functional group. Such leaving groups are well known in the art, and examples include, but are not limited to, a halide (e.g., chloride, bromide, and iodide), methanesulfonyl (mesyl), p-toluenesulfonyl (tosyl), trifluoromethylsulfonyl (triflate), and trifluoromethylsulfonate.

The phrase "pharmaceutically acceptable salt," as used herein, refers to pharmaceutically acceptable organic or inorganic salts of a compound (e.g., a Medicant Linker compound, or an Affinity Medicant Linker conjugate). The compound typically contains at least one amino group, and accordingly acid addition salts can be formed with this amino group. Exemplary salts include, but are not limited to, sulfate, citrate, acetate, oxalate, chloride, bromide, iodide, nitrate, bisulfate, phosphate, acid phosphate, isonicotinate, lactate, salicylate, acid citrate, tartrate, oleate, tannate, pantothenate, bitartrate, ascorbate, succinate, maleate, gentisinate, fumarate, gluconate, glucuronate, saccharate, formate, benzoate, glutamate, methanesulfonate, ethanesulfonate, benzenesulfonate, p-toluenesulfonate, and palmoate (i.e., 1,1'-methylene-bis-(2-hydroxy-3-naphthoate)) salts. A pharmaceutically acceptable salt may involve the inclusion of another molecule such as an acetate ion, a succinate ion or other counter ion. The counter ion may be any organic or inorganic moiety that stabilizes the charge on the parent compound. Furthermore, a pharmaceutically acceptable salt may have more than one charged atom in its structure. Instances where multiple charged atoms are part of the pharmaceutically acceptable salt can have multiple counter ions. Hence, a pharmaceutically acceptable salt can have one or more charged atoms and/or one or more counter ion.

As used herein, a "pharmaceutically acceptable solvate" or "solvate" refer to an association of one or more solvent molecules and a compound of the invention, e.g., an Affinity Medicant Linker conjugate or a Medicant Linker compound. Examples of solvents that form pharmaceutically acceptable solvates include, but are not limited to, water, isopropanol, ethanol, methanol, DMSO, ethyl acetate, acetic acid, and ethanolamine.

The following abbreviations are used herein and have the indicated definitions: Boc is N-(t-butoxycarbonyl), cit is citrulline, dap is dolaproine, DCM is dichloromethane, DIEA is N,N-diisopropylethylamine, dil is dolaisoleuine, DMF is N,N-dimethylformamide, DMSO is dimethylsulfoxide, doe is dolaphenine, dov is N,N-dimethylvaline, DTNB is 5,5'-dithiobis(2-nitrobenzoic acid), DTPA is diethylenetriaminepentaacetic acid, DTT is dithiothreitol, Fmoc is N-(9-fluorenylmethoxycarbonyl), gly is glycine, HATU is O-(7-azabenzotriazol-1-yl)-N,N,N',N'-tetramethyluronium hexafluorophosphate, HBTU is 2-[1H-benzotriazole-1-yl]-1,1,3,3-tetramethylaminium hexafluorophosphate; HOBt is 1-hydroxybenzotriazole, HPLC is high pressure liquid chromatography, ile is isoleucine, lys is lysine, MeOH is methanol, MeVal is N-methyl-valine, PAB is p-aminobenzyl, PBS is phosphate-buffered saline (pH 7.4), Ph is phenyl, phe is L-phenylalanine, PyBrop is bromo tris-pyrrolidino phosphonium hexafluorophosphate. TFA is trifluoroacetic acid, UV is ultraviolet, and val is valine.

The following LU abbreviations are used herein and have the indicated definitions: Val Cit or vc is a valine-citrulline dipeptide site in protease cleavable linker; PABC is p-aminobenzylcarbamoyl; (Me)vc is N-methyl-valine citrulline, where the linker peptide bond has been modified to prevent its cleavage by cathepsin B; and $MC(PEG)_6$-OH is maleimidocaproyl-polyethylene glycol.

As used herein, a "pegylated compound" refers to a compound conjugated with two or more polyethylene glycol moieties or two or more polypropylene glycol moieties or a combination thereof.

As used herein, a "pro-peptide" includes pro-peptide, pre-peptide, pro-protein and pre-protein amino acid sequences including those amino acid sequences cleaved by enzymes disclosed in Table IX.

As used herein, "Illudin1" or "illudin-1" means those analogs disclosed in Table XI. As used herein "Illudin2" or "illudin2" means those analogs disclosed in Table XI and Table XII. As used herein, "acylfulvene" means "illudin2" and any analog derived therefrom.

Malignant neoplasia is the second most common cause of death in the United States behind cardiovascular disease. Chemotherapy has exerted a predominant role in increasing life spans for patients with a variety of tumors including Burkitt's lymphoma, acute lymphocytic leukemia and Hodgkin's disease. Further, new cancer chemotherapeutic agents and methods of care combined with early detection and treatment have resulted in decreases in the overall incidence of cancer and decreases in the death rates from all cancers combined. Responsive tumors represent only a small fraction of the various types of cancer. Further, agents such as cyclophosphamide, adriamycin, 5-fluorouracil and hexamethylmelamine, which are highly active against clinical solid tumors, are limited. Thus, patients with many types of malignancies remain at significant risk for relapse and mortality. After relapse, some patients can be re-induced into remission with their initial treatment regimen. However, higher doses of the initial chemotherapeutic agent or the use of additional agents are frequently required, indicating the development of at least partial medicant resistance. Evidence indicates medicant resistance can develop simultaneously to several agents, including medicant resistance to treatments to which the patient was not exposed. The development of multiple-medicant resistant tumors may be a function of tumor mass and constitutes a major cause of treatment failure. To overcome this medicant resistance, high-dose chemotherapy with or without radiation and allogenic or autologous bone marrow transplantation can be employed. The high-dose chemotherapy may employ the original medicant(s) or be altered to include additional agents. As a result, there remain many cancer patients for whom no or minimally effective therapy exists. Accordingly, there is a need for the development of novel chemotherapeutics with greater efficacy or safety, either as monotherapy or in combination with other chemotherapeutic agents, and such agents with the potential to overcome medicant resistance in cancer cells.

Figure 20A:
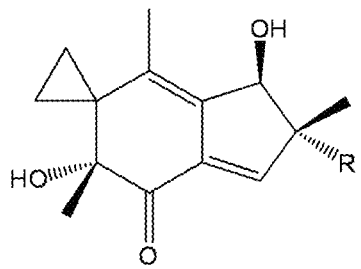
FIG. 20A shows an illudin analog according to various embodiments of the invention.
Figure 20B:
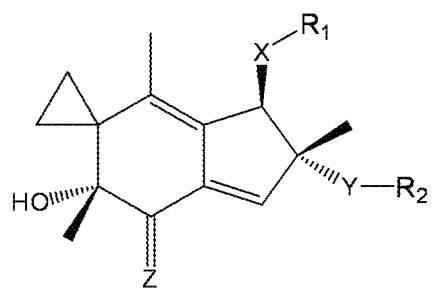
FIG. 20B shows a syn-illudin analog according to various embodiments of the invention.
Figure 20C:
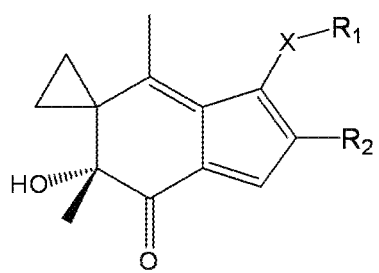
FIG. 20C and FIG. 20D show acylfulvene analogs according to various embodiments of the invention.
Figure 20D:
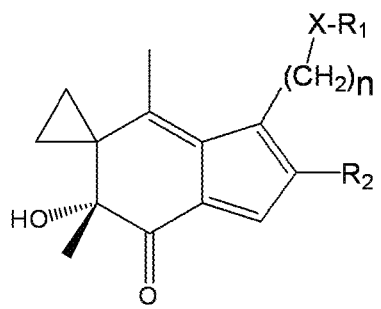

Illudins are toxic natural products produced by mushrooms of the genus *Omphalotus* (FIG. 20A). Syn-illudins are semi-synthetic derivatives of Illudins. Acylfulvenes are also semi-synthetic derivatives of Illudins. Syn-Illudins and Acylfulvenes have each been chemically modified at select sites to allow their use as medicants. The modifications in the Syn-Illudins do not alter any of the cyclic rings (cyclopropane, cyclopentane, cyclohexane) of the basic Illudin chemical structure (FIG. 20B). The modifications of Acylfulvenes differ from Syn-Illudins in that an additional double bond (an unsaturated bond) has been created in the 5 membered (cyclopentane) ring (FIG. 20C, FIG. 20D).

Figure 6:
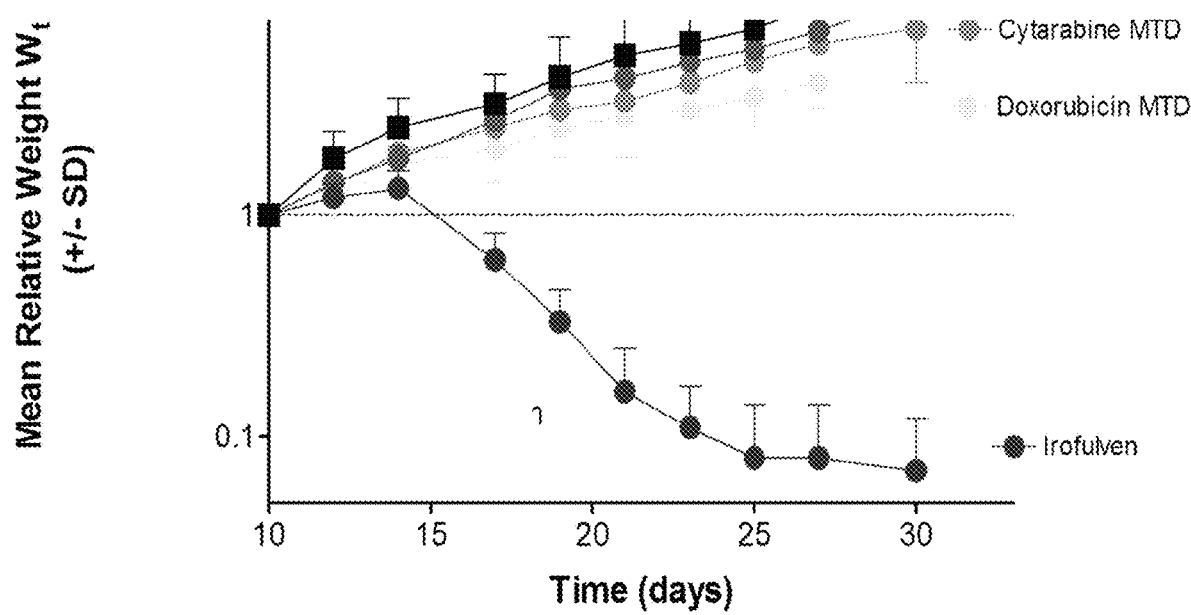
FIG. 6 shows the tumor regression of an acylfulvene analog, according to an embodiment of the invention.

Illudins function as alkylating agents that damage DNA and thereby block transcription. The blockage can be repaired through nucleotide excision. The toxicity of the illudins has prevented any applications in human tumor therapy. Acylfulvenes have been developed which exhibit promising antitumor activity with a better safety profile, as described in U.S. Pat. Nos. 5,439,936; 5,523,490 and 6,380,403 which ae each herein expressly incorporated by reference in their entireties. Irofulven or 6-hydroxymethylacylfulvene (see FIG. 6) is an analog of illudin S which has demonstrated clinical activity with an acceptable safety profile in hormone-refractory prostate cancer. Most relevant to clinical applications, irofulven activity is independent of common resistance mechanisms such as the multi-medicant resistance phenotype, anti-apoptotic B-cell lymphoma 2 (Bcl-2) (SEQ. ID. 056) over expression, as well as tumor protein 53 (p53) (SEQ. ID. 057) and cyclin dependent kinase inhibitor 1 (p21/WAF1) (SEQ. ID. 058) mutations (see FIG. 7 and Table XIV).

Growth factors, including peptides and proteins are critical mediators of a wide range of cell-cell communication. They are important endocrine, paracrine and autocrine messengers. Growth factors function as neurotransmitters and neuromodulators, regulate chemotaxis, immune function, development, cell growth, and can influence tumor cells. The receptors that recognize growth factors are highly selective and define specific cell populations. As a result, growth factor receptors are a large and important class of medicant (including drug) targets. In addition to physiologic noncancerous cell populations, these receptors can also be expressed in various cancer cell populations.

A polypeptide is a long, continuous, and unbranched chain of amino acids. A glycol-peptide is a peptide that contains one or more carbohydrate moieties covalently attached to the side chains of specific amino acids. A pro-peptide, is an inactive peptide that can be turned into an active form through a post translational modification that enzymatically cleaves the pro-peptide. Examples include pro-insulin (SEQ. ID. 059) and pro-opiomelanocortin (SEQ. ID. 060). Enzymatically cleaving the pro-peptide, allows for the peptide to be available on short notice and/or in large quantities. Some pro-peptides are secreted from the cell. Many of these are synthesized with an N-terminal signal peptide that targets the pro-peptide for secretion.

Cytokines are small proteins (approximately 5 to 20 kDa) that affect the behavior of other cells, and sometimes the releasing cell itself and are thereby important in cell signaling (see Table XIV). Many specific cytokines can be released by a variety of different kinds of cells, e.g., macrophages, B lymphocytes, T lymphocytes, mast cells, endothelial cells, fibroblasts, and various stromal cells. Cytokines act through specific receptors, and are important in the humoral and cell-based immune responses. Cytokines also regulate the maturation, growth, and responsiveness of specific cell populations. Cytokines circulate in much higher concentrations than hormones and in contrast with hormones are made by a variety of different kinds of cells. Cytokines are important in host responses to infection, immune responses, inflammation, trauma, sepsis, cancer, and reproduction. As a result, cytokine receptors are upregulated in many forms of cancers.

A steroid is an organic compound that contains four cycloalkane rings joined to each other. Examples of steroids include the dietary lipid cholesterol and the sex hormones estradiol and testosterone. The core of a steroid molecule is composed of seventeen carbon atoms bonded together that take the form of four fused rings: three six-carbon atom rings and one five-carbon atom ring. A variety of functional groups can be attached to the four-ring core. Steroids can also vary depending on the oxidation state of the rings. A steroid hormone is a steroid that acts as a hormone. Steroid hormones can be grouped into five groups (glucocorticoids, mineralocorticoids, androgens, estrogens, and progesterones) based on the receptors to which they bind. Steroid hormones, particularly androgens, are essential not only for growth and development but also in the progression of many forms of cancer. As a result, steroid hormone receptors are upregulated in many forms of cancers.

The retinoic acid receptor (RAR) is a nuclear receptor which can also act as a transcription factor. The RAR can be activated by either all-trans retinoic acid or 9-cis retinoic acid. There are three RAR isoforms (alpha (SEQ. ID. 061), beta (SEQ. ID. 062), and gamma (SEQ. ID. 063)), each encoded by separate genes, where splice variants generate still further diversity in the expressed receptor. The retinoid X receptor (RXR) is a nuclear receptor activated by 9-cis retinoic acid. There are also three RXR isoforms (alpha (SEQ. ID. 064), beta (SEQ. ID. 065), and gamma (SEQ. ID. 066)), each encoded by separate genes. RXR hetero-dimerizes with subfamily 1 nuclear receptors including RAR. In the absence of ligand, the RAR/RXR dimer binds to retinoic acid response elements complexes with a co-repressor protein. Binding of agonist ligands to RAR results in dissociation of the co-repressor and recruitment of a co-activator protein that, in turn, promotes transcription of the downstream target gene into mRNA and thereby protein or other RNA signaling mechanisms.

Lipid metabolism is altered in many forms of cancer, including upregulation of de novo lipid synthesis. Cancer cells can also use alternative enzymes' and pathways to facilitate the production of fatty acids. These newly synthesized lipids may support a number of cellular processes to promote cancer cell proliferation and survival. Elaidic acid or (E)-octadec-9-enoic acid is the trans isomer of oleic acid and is found in small quantities in caprine milk, bovine milk and some meats. It increases Cholesteryl Ester Transfer Protein (CETP) (SEQ. ID. 067) activity, which in turn raises levels of very low density lipoprotein and lowers levels of high density lipoprotein (HDL) cholesterol. CETP is found in plasma, where it is involved in the transfer of cholesteryl ester from HDL to other lipoproteins. Defects in the CETP gene are a cause of hyperalphalipoproteinemia 1.

An antibody is a protein made up of four peptide chains disulfide linked together to form a "Y"-shape. Antibodies are produced by plasma cells and are used by the immune system to identify and neutralize foreign antigens such as bacteria and viruses. The antibody recognizes a unique part of the antigen using each FAB portion of the protein (i.e., the tip of the "Y" portion of the antibody), allowing a specific high affinity binding interaction to occur. The binding interaction of different antibodies can target specific antigen epitopes. An antibody fragment containing one or both PAB portions can also target specific antigen epitopes.

The ability of the Illudin, Syn-illudin and Acylfulvene analogs to inhibit tumor cell growth is shown in Table XV. The MV522 cell line is a lung-derived adenocarcinoma cell line. In various embodiments of the invention, the MV522 cell line represents a "target" cell line. That is an Illudin, Syn-Illudin or Acylfulvene analog that exhibits toxicity against this solid tumor cell line shows a desirable result. The 8392B cell line represents a hematopoietic (non-solid) cell line. In various embodiments of the invention, the 8392B cell line is considered a "nontarget" cell line. The two hour toxicity data represents the concentration of a given analog for which a two hour exposure will inhibit 50% of the DNA synthesis activity in a given cell line. The 48 hour exposure data represents the concentration at which a given analog with a 48 hour exposure will inhibit the growth or viability in a given cell line as defined by the standard Trypan Blue Exclusion assay. As an example, analog 002 will inhibit the target MV522 cell line at 110 nM with only a 2 hour exposure but has no inhibitory effect on the nontarget 8392B cell line at 26,000 nM (26 µM). Analog 002 with a prolonged exposure period (e.g. 48 hours) can eventually inhibit the nontarget cell line. In contrast, Analog 201 will inhibit the target MV522 cell line with only a 2 hour exposure (IC50=360 nM) but has minimal effect on the 8392B cell nontarget line with even a 48 hour exposure (IC50=26,000 nM) indicating superior anticancer activity as a monotherapeutic agent. In contrast to these two analogs, analog 224 displayed minimal toxicity as well as no differential toxicity between the target and nontarget cell line indicating it would have minimal properties as a monotherapeutic anticancer agent.

As used herein, a "growth factor" or an "anti-angiogenic protein" includes Adrenomedullin (SEQ. ID. 068), Angiopoietin (Ang) (SEQ. ID. 069, 106, 111, and 145), Autocrine motility factor (SEQ. ID. 070), Bone morphogenetic proteins (BMPs) (SEQ. ID. 071), Brain-derived neurotrophic factor (BDNF) (SEQ. ID. 072), Endostatin (SEQ. ID. 073), Endostar (SEQ. ID. 074), Epidermal growth factor (EGF) (SEQ. ID. 075), Erythropoietin (EPO) (SEQ. ID. 076), Fibroblast growth factor (FGF) (SEQ. ID. 077), Glial cell line-derived neurotrophic factor (GDNF) (SEQ. ID. 078), Granulocyte colony-stimulating factor (G-CSF) (SEQ. ID. 079), Granulocyte macrophage colony-stimulating factor (GM-CSF) (SEQ. ID. 080), Growth differentiation factor-9 (GDF9) (SEQ. ID. 081), Hepatocyte growth factor (HGF) (SEQ. ID. 082), Hepatoma-derived growth factor (HDGF) (SEQ. ID. 083), Insulin-like growth factor (IGF) (SEQ. ID. 084), Migration-stimulating factor (SEQ. ID. 085), Myostatin (GDF-8) (SEQ. ID. 086), Nerve growth factor (NGF) (SEQ. ID. 087) and other neurotrophins (SEQ. ID. 144), Platelet-derived growth factor (PDGF A) (SEQ. ID. 088), PDGF B (SEQ. ID 168), PDGF C (SEQ. ID. 036), PDGF D (SEQ. ID. 037), Thrombopoietin (TPO) (SEQ. ID. 089), Transforming growth factor alpha(TGF-α) (SEQ. ID. 090), Transforming growth factor beta(TGF-β) (SEQ. ID. 091), Tumor necrosis factor-alpha(TNF-α) (SEQ. ID. 092), Vascular endothelial growth factor (VEGF) (SEQ. ID. 093), and placental growth factor (PIGF) (SEQ. ID. 094).

As used herein, a "protein toxin" includes ricin A chain (SEQ. ID. 095), ricin B chain (SEQ. ID. 096), diphtheria toxin (SEQ. ID. 097), *Pseudomonas aeurginosa* exotoxin A (SEQ. ID. 098), r-gelonin (SEQ. ID. 099), saporin (SEQ. ID. 100), glycosylated protein toxins, degicosylated protein toxins and protein toxin fragments which includes deglycosylated ricin A, deglycosylated ricin B, *Pseudomonas aeurginosa* exotoxin A PE40 fragment (SEQ. ID. 101) and *Pseudomonas aeurginosa* exotoxin A PE38 fragment (SEQ. ID. 102).

As used herein, a "steroid" includes cholesterol (5-cholesten-3beta-ol), pregnenolone (3beta-hydroxy-5-pregnen-20-one), 17-hydroxyprenenolone (3-beta,17-dihydroxy-5-pregnen-20-one), progesterone (4-pregnene-3,20-dione), 17-hydroxyprogesterone (17-hydroxy-4-pregnene-3,20-dione), androstenedione (4-androstene-3,17-dione), 4-hydroxyandrostenedione (4-hydroxy-4-androstene-3,17-dione), 11-beta-hydroxyandostenedione (11beta-4-androstene-3,17-dione), androstanediol (3-beta,17-beta-Androstanediol), androsterone (3-alpha-hydroxy-5alpha-androstan-17-one), epiandrosterone (3-beta-hydroxy-5alpha-androstan-17-one), adrenosterone (4-androstene-3,11,17-trione), dehydroepiandrosterone (3beta-hydroxy-5-androsten-17-one), dehydroepiandrosterone sulfate (3-beta-sulfooxy-5-androsten-17-one), testosterone (17beta-hydroxy-4-androsten-3-one), epitestosterone (17-alpha-hydroxy-4-androsten-3-one). 5-alpha-dihydrotesterone (17-beta-hydroxy-5alpha-androstan-3-one), 5-beta-dihydrotestosterone (17-beta-hydroxy-5beta-androstan-3-one), 11-beta-hydroxytesosterone (11-beta,17beta-dihydroxy-4-androsten-3-one), 11-ketotestosterone (17-beta-hydroxy-4-androsten-3,17-dione), estrogen (including: estrone (3-hydroxy-1,3,5(10)-estratrien-17-one), estradiol (1,3,5(10)-estratriene-3,17beta-diol), and estriol (1,3,5(10)-estratriene-3,16alpha,17beta-triol)), corticosterone (11-beta,21-dihydroxy-4-pregnene-3,20-dione), deoxycorticosterone (21-hydroxy-4-pregnene-3,20-dione), cortisol (11-beta,17,21-trihydroxy-4-pregnene-3,20-dione), 11-deoxycortisol (17,21-dihydroxy-4-pregnene-3,20-dione), cortisone (17,21-dihydroxy-4-pregnene-3,11,20-trione), 18-hydroxycorticosterone (11-beta,18,21-trihydroxy-4-pregnene-3,20-dione), 1-alpha-hydroxycorticosterone (1-alpha,11-beta,21-trihydroxy-4-pregnene-3,20-dione), and aldosterone (18,11-hemiacetal of 11beta,21-dihydroxy-3,20-dioxo-4-pregnen-18-al).

As used herein, a "Specific Binding Peptide" includes an "anti-angiogenic peptide" (SEQ. ID. 146) and an "integrin binding peptide" (SEQ. ID. 147). A "Specific Binding Peptide" includes integrin binding peptide RGD4C=CDCRGDPC (SEQ. ID. 147), integrin binding peptide RGD10 (SEQ. ID. 148), c(RGDyK) (SEQ. ID. 149), integrin binding peptide c(RGDfK) (SEQ. ID. 150), integrin binding peptide [c(RGDyK)]2 (SEQ. ID. 151), integrin binding peptide CAGKNFFWKTFTSC (SEQ. ID. 152), cilengitide (cyclic RGD pentapeptide) (SEQ. ID. 153), ATN-161 (peptide antagonist of integrin alpha5beta1) (SEQ. ID. 154), ATN-454 (Ac—PHSCN—NH$_2$) (peptide antagonist of integrin alpha5beta1) (SEQ. ID. 155), tumstatin 17 peptide TMPFLFCNVNDVCNFASRNDYSYWL (SEQ. ID. 156), tumstatin sequence 1 YSNS (SEQ. ID. 157), tumstatin sequence 2 YSNSG (SEQ. ID. 158), endostatin motif FLSSRLQDLYSIVRRADRAA (SEQ. ID. 159), endostatin motif IVRRADRAAVP (SEQ. ID. 160), laminin peptide A13 (RQVFQVAYIIIKA) (SEQ. ID. 161), laminin peptide C16 (KAFDITYVRLKF) (SEQ. ID. 162), laminin peptide C16S (DFKLFAVTIKYR) (SEQ. ID. 163), and VEGFR1 peptide (CPQPRPLC) (SEQ. ID. 164).

As used herein, a traditional linker includes linkers that can be formed from those reagents disclosed in Tables IA-ID, IIA-IID, IIIA-IIIC, IVA-IVC, VA-VB, and VIA-VID.

Figure 15A:
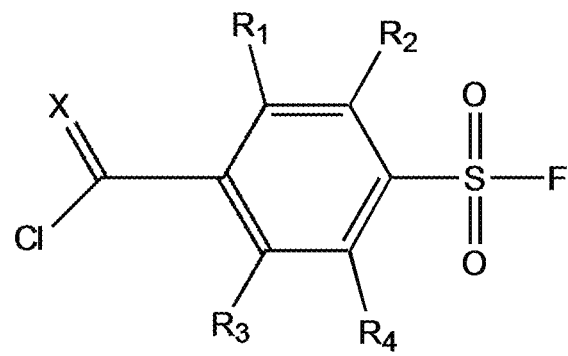
FIG. 15A shows the structures of 4-fluorosulfonyl benzoyl.
Figure 15B:
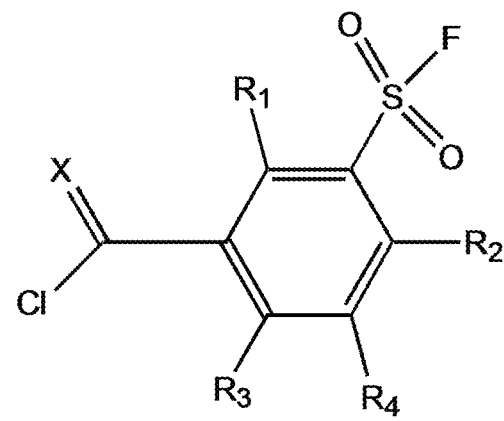
FIG. 15B shows the structure of 4-fluorosulfonyl benzoyl, 3-fluorosulfonyl benzoyl.
Figure 15C:
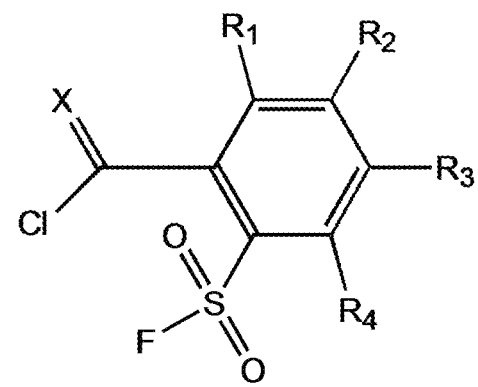
FIG. 15C show the structures of 2-fluorosulfonyl benzoyl where $R_1$, $R_2$, $R_3$, and $R_4$ independently denote H, F, Cl, Br and I.
Figure 16A:
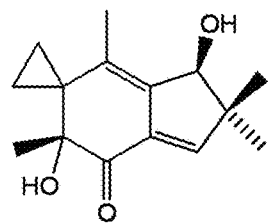
FIG. 16A shows the structure of Illudin M.
Figure 16B:
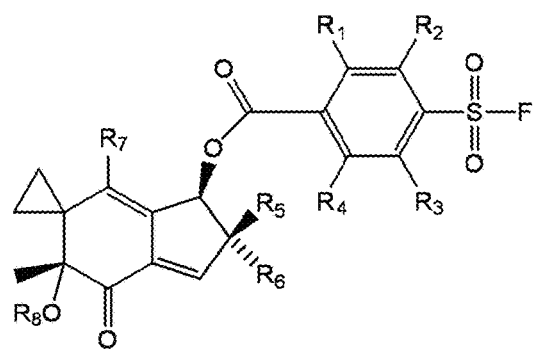
FIG. 16B shows a mono-substituted product formed by reacting Illudin M on the secondary hydroxyl to form 4-FSB linking reagent according to an embodiment of the invention.
Figure 16C:
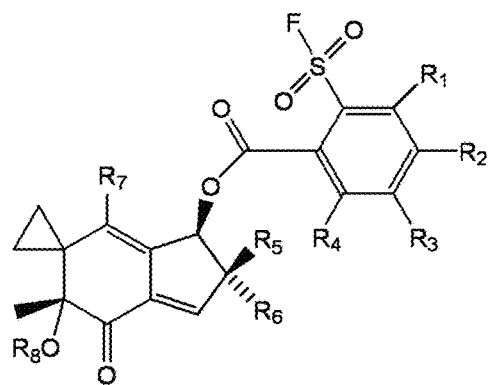
FIG. 16C shows a mono-substituted product formed by reacting Illudin M on the secondary hydroxyl to form 2-FSB linking reagent according to an embodiment of the invention.
Figure 16D:
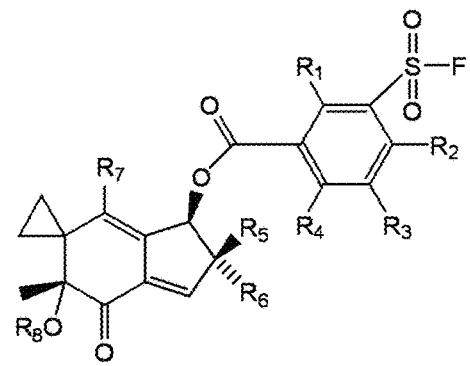
FIG. 16D a mono-substituted product formed by reacting Illudin M on the secondary hydroxyl to form 3-FSB linking reagent according to an embodiment of the invention.
Figure 17A:
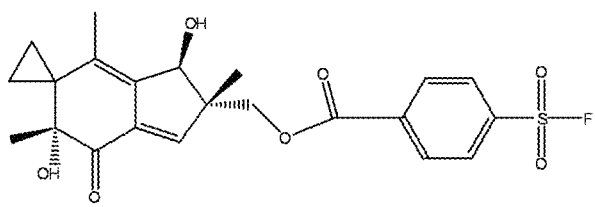
FIG. 17A shows the structure of the Illudin S FSB mono-substituted on the primary hydroxy reagent according to an embodiment of the invention.
Figure 17B:
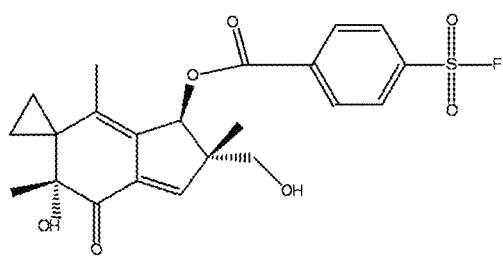
FIG. 17B shows the structure of the Illudin S FSB mono-substituted on the secondary hydroxy reagent according to an embodiment of the invention.
Figure 17C:
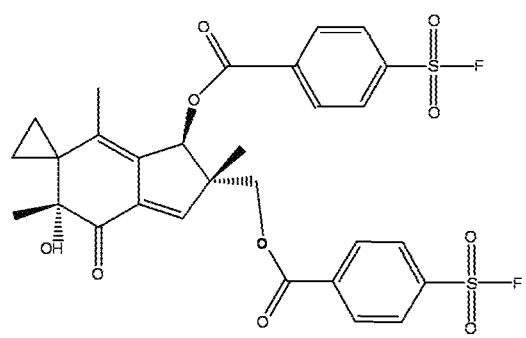
FIG. 17C shows the structure of the Illudin S FSB di-substituted reagent according to an embodiment of the invention.
Figure 18:
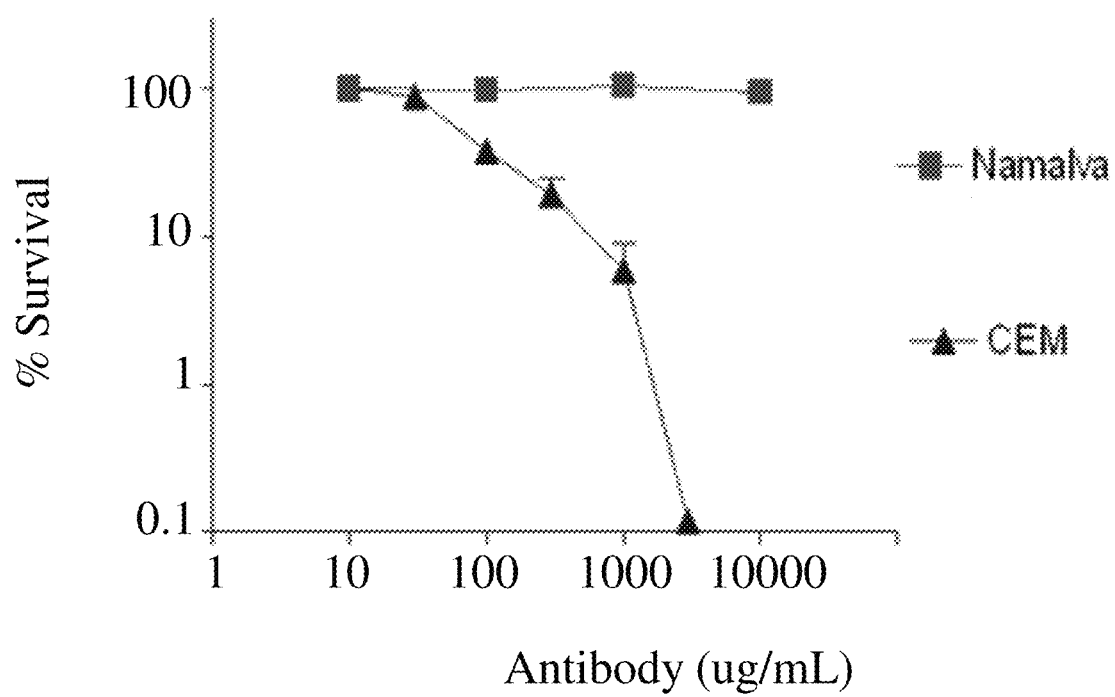
FIG. 18 shows the response of an ADC made by combining analog 316 with the T101 antibody according to an embodiment of the invention, where the percent of control is plotted versus the concentration of Namalva, a negative control (i.e., a cell line not expressing T101) where the $IC_{50}$>1000 ng/mL and CEM, a positive control (i.e., a cell line expressing T101) where the $IC_{50}$<5 ng/mL, after a four (4) hour exposure and then eighteen (18) hour recovery, where the toxin to antibody ratio is 5:1 (as determined using a radiolabelled toxin) and where the concentration is in Illudin equivalents (ng of Illudin attached to antibody per mL of cell culture media), which demonstrates the ability of T101-316 ADC to kill cells expressing T101 antigen on their surface but not cells that fail to express the T101 antigen.
Figure 19A:
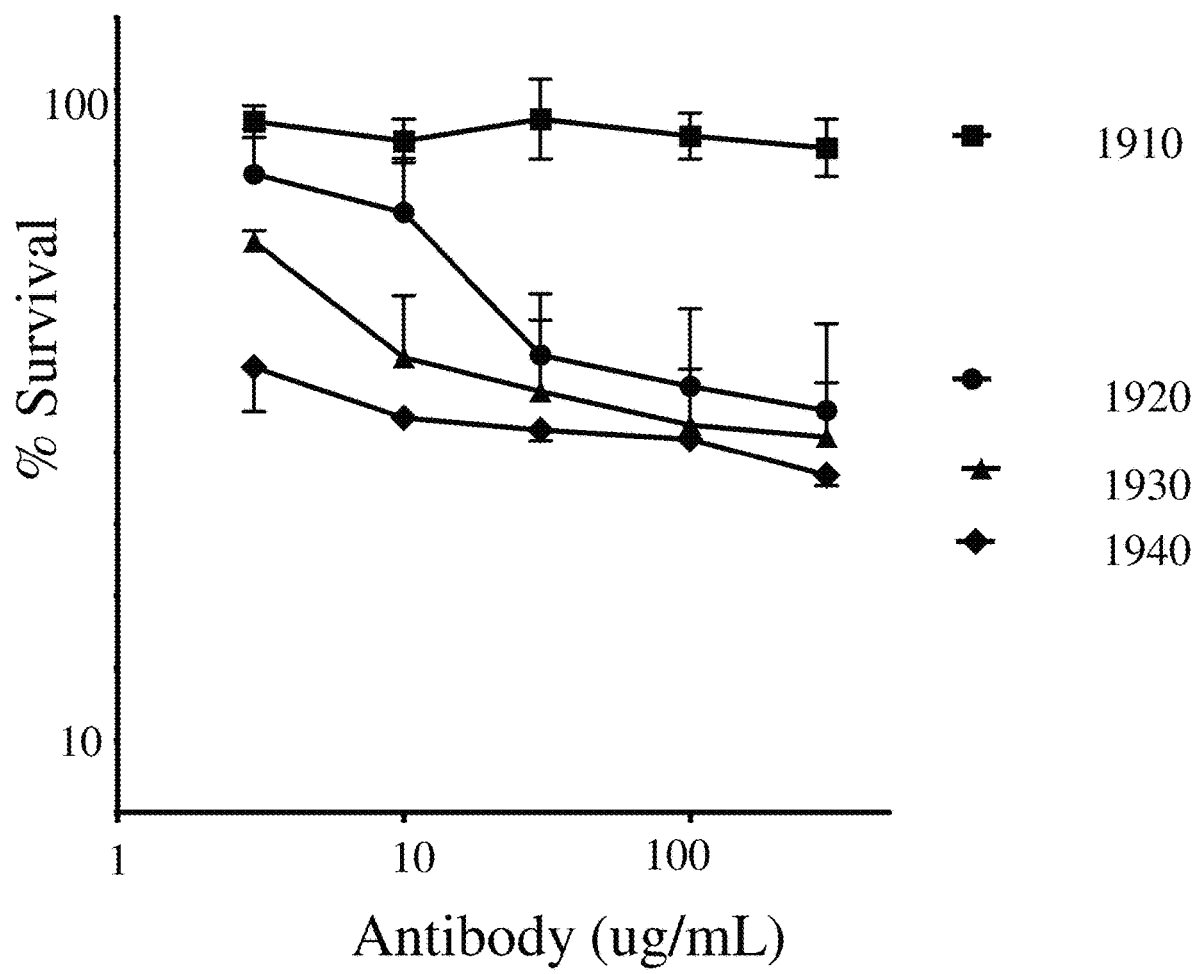
FIG. 19A shows the activity (percent survival of the Rituxin antibody alone is proportional to CD20 expression on B cells (where MV522 cells are CD20 negative 1910, 8392 cells express low numbers of CD20 1920, Raji express medium numbers of CD20 1930 and Ramos express high numbers of CD20 molecules) 1940, and where B cells are relatively resistant to Illudins and irofulvens (48 hr $IC_{50}$>7,000 nM)
Figure 19B:
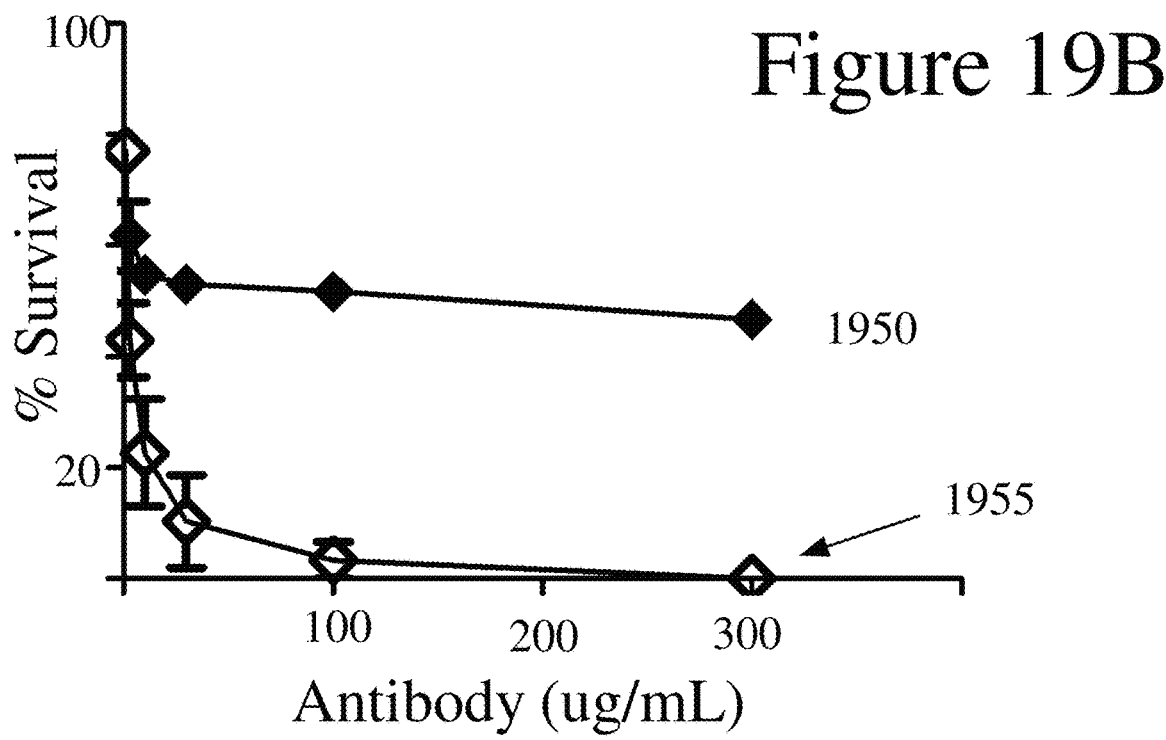
FIG. 19B shows the activity of the Rituxin antibody alone 1950 compared with an ADC of Rituxin with analog 218 on Ramos cells 1955.
Figure 19C:
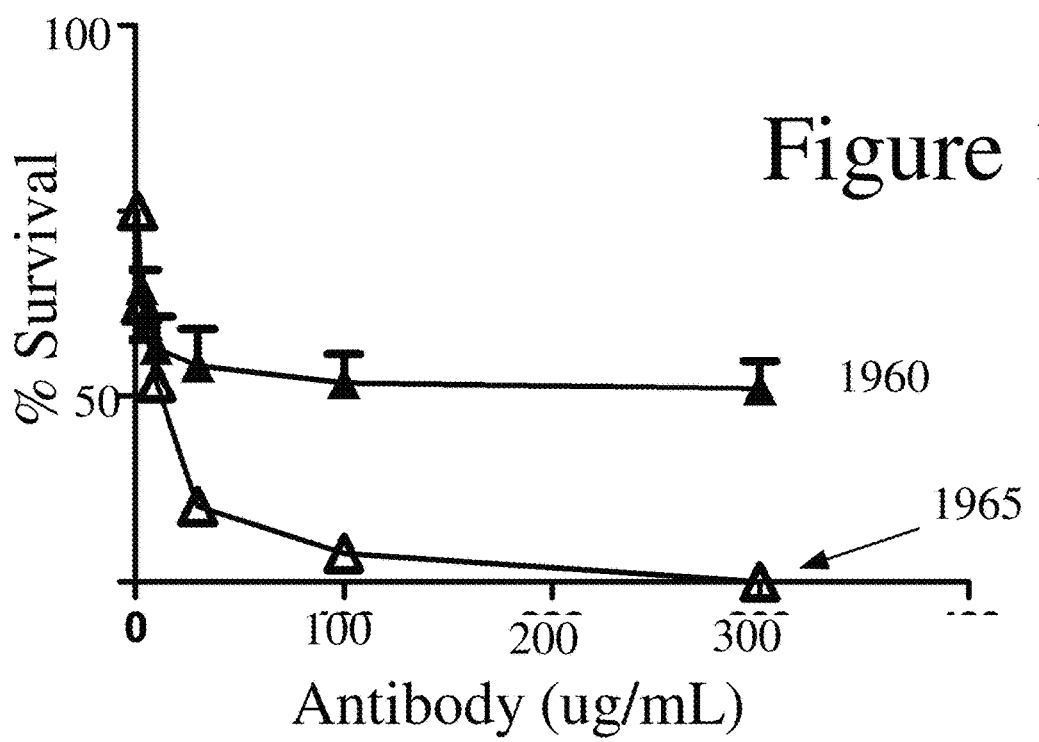
FIG. 19C shows the activity of the Rituxin antibody alone 1960 compared with an ADC of Rituxin with analog 218 on Raji cells 1965.
Figure 19D:
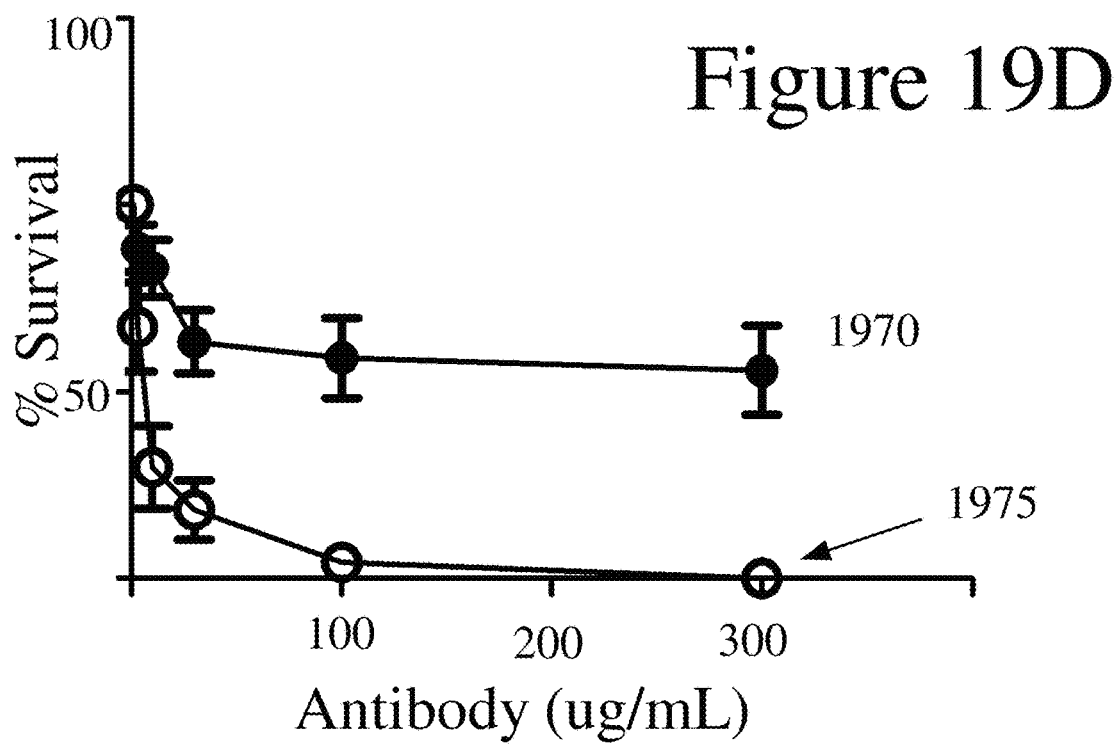
FIG. 19D shows the activity of the Rituxin antibody alone 1970 compared with an ADC of Rituxin with analog 218 on 8392 cells 1975.
Figure 19E:
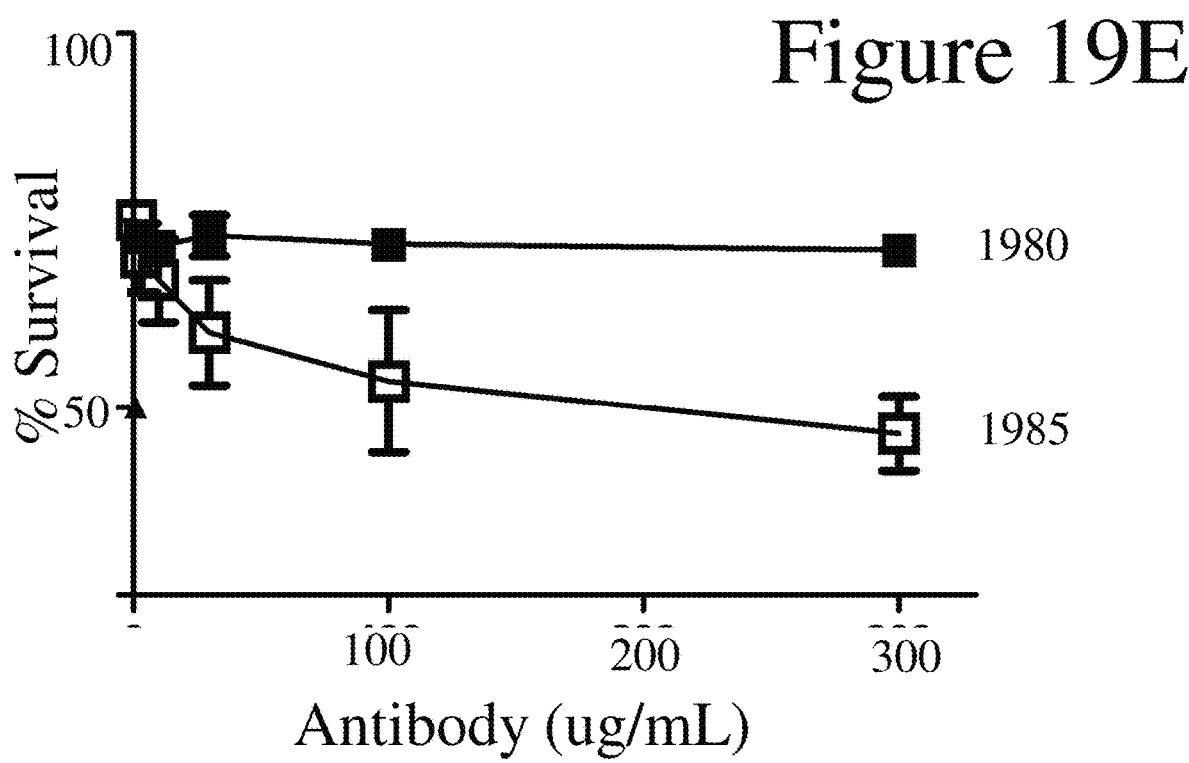
FIG. 19E shows the activity of the Rituxin antibody alone 1960 compared with an ADC of Rituxin with analog 218 on MV522 cells (where MV522 cells grew in the presence of the Rituxan—analog 218 ADC but at a slower rate than in the absence of analog 218 ADC) 1985).

As used herein, a "FSB linker" includes those linkers selected from the group consisting of 4-fluorosulfonyl benzoyl, 3-fluorosulfonyl benzoyl and 2-fluorosulfonyl benzoyl as depicted in FIG. 15.

As used herein, a "Mall" linker includes a malonic linker and a maleimide linker covalently attached to an Illudin, Syn-Illudin, or Acylfulvene.

As used herein, a "protease" includes those enzymes disclosed in Table IX.

As used herein, a "cytokine" includes chemokines, interferons, interleukins, lymphokines, tumor necrosis factor, neutrophil activating protein-2, and monocyte chemotactic protein-1 and those compounds disclosed in Table XIV.

Despite recent advances in therapy, many patients with cancer invariably relapse and require additional treatments. Most of these patient's cancers become refractory to standard chemotherapy and/or radiation treatment regimens. The prognosis for these patients is poor and long term survival rates for metastatic solid tumor cancers remain very low. Thus, there is a need for the development of novel agents and treatment regimens that specifically target these recurring tumor cells and also produce less systemic toxicity. Target therapies, such as monoclonal antibodies, now provide a promising alternative to the conventional cytotoxic chemotherapy approach.

Monoclonal antibody based therapy has recently achieved considerable success in oncology and there are currently nine monoclonal antibodies (without a medicant attached) approved by the FDA as cancer therapeutics. As an example, HERCEPTIN® and RITUXAN® (both produced by Genentech, South San Francisco, Calif.), are used to successfully treat breast cancer and non-Hodgkin's lymphoma, respectively. HERCEPTIN® is a recombinant DNA-derived humanized monoclonal antibody selectively binding to the extracellular domain of the Human Epidermal growth factor Receptor 2 (HER2) proto-oncogene whereas RITUXAN® is a genetically engineered chimeric murine/human monoclonal antibody directed against the CD20 antigen overexpressed on the surface of normal and malignant B lymphocytes.

Recent clinical evidence indicates that while the monoclonal antibody based therapies are effective at inducing remission, they do not always produce a complete cure, and relapses eventually occur in most patients. There is now a tremendous interest in the use of antibody medicant conjugates as a class of therapeutics that utilize the antigen-selectivity of monoclonal antibodies to deliver potent cytotoxic medicants to specific tumor cells. Antibody medicant conjugates are produced by attaching a cytotoxic agent to an antibody that binds specifically to a tumor-associated antigen.

In theory, antibody medicant conjugates can confer an increased therapeutic index to highly potent medicants by improving therapeutic efficacy and reducing systemic toxicity (by minimizing damage to normal tissues), although this goal has been elusive in achieving. The basis for the efficacy of antibody medicant conjugates is that they target tumor cells that preferentially express an antigen that is recognized by the associated antibody. In contrast, non-tumor cells either fail to express this antigen, or express the antigen at a very low level. In theory, only the tumor cells expressing the associated antibody are recognized and destroyed by the AMC, and other cells are left untouched and undamaged.

While different medicant classes have been tried for delivery via antibodies, only a few have proved efficacious for use as antibody medicant conjugates. The two main medicant classes used to date to produce antibody medicant conjugates are the auristatins (MMAE/N-methylvaline-valine-dolaisoleuine-dolaproine-norephedrine or MMAF/N-methylvaline-valine-dolaisoleuine-dolaproine-phenylalanine) and the maytansines (DM1 or DM4). Currently only two antibody medicant conjugates are approved by the U.S.F.D.A. and marketed; brentuximab vedotin (auristatin based) and ado-trastuzumab emtansine (maytansine based).

Illudins (see FIG. 20A, where R=CH$_3$OH or OH), Syn-illudins (see FIG. 20B, where X or Y=C, N, S, O and Z=O or NH or NOH), and Acylfulvenes (see FIG. 20C and FIG. 20D, where X=C, N, S, O and n≥1) have several unique properties over agents traditional used to make antibody drug conjugates (ADCs). Firstly, these are the only agents known to function by inhibition of the DNA transcription-coupled repair pathway (see FIG. 5). No other toxin, drug or medicant inhibits this pathway. The result is that Illudins, Syn-illudins, and Acylfulvenes are true cytotoxic agents whereas other agents traditionally used to produce ADCs (pyrrolobenzodiazepines, maytansines, fumagillols, dolstatins, auristatins, enadiynes, halichondrins, and tubulysins) are only cytostatic. In the NCI-DTP 60 cell line panel these other agents were capable of inhibiting tumor cell growth ($IC_{50}$ value), had some ability to block tumor cell growth (TGI value) but none were capable of actually causing tumor cell death or cytotoxicity (Table XIII). The illudin derivatives, however, are capable of killing tumor cells at nanomolar concentrations (Table XIII). This means that while ADCs developed using other toxins can stall tumor cell growth, they cannot actually kill the tumor cell. Once the effect of the drug has worn off the tumor cells will again grow and kill the patient. In contrast, the Illudins, Syn-illudins, and Acylfulvenes actually kill the tumor cell with as little as a 2 hour exposure (see FIG. 4). Secondly, whereas tumor cells will undergo apoptosis or cell death with hours once the DNA transcription-coupled repair pathway is blocked, normal diploid non-tumor cells can survive for hours. This translates into a wide therapeutic window for ADCs developed with Illudins, Syn-illudins, and Acylfulvenes. The two ADC agents currently FDA approved for administration deliver a dose of the associated toxin that is 300% higher than a lethal dose which is why these agents have severe systemic toxicity. In contrast, the comparable ADC developed with Illudins, Syn-illudins, or Acylfulvenes will deliver a dose of the associated toxin that is 40% of a known non-toxic dose (estimated at 28% of a toxic dose and only 12% of a lethal dose). Thus, ADCS developed with Illudins, Syn-illudins, and Acylfulvenes will have minimal systemic toxicity as compared to current agents. Thirdly, these agents are stable down to a pH1 of 2.0. An ADC is engulfed by a tumor cell, transported to the endosomes (pH<6.0) and then into the lysozomes (pH<4). Many agents used for ADCs will degrade in these low pH environment, whereas Illudins, Syn-illudins, and Acylfulvenes are stable. 4) Cancer cells can become resistant to various toxins and drugs through the development of what is termed multi-drug resistance. This process is known to occur through several different mechanisms. Whereas other toxins and drugs are substrates for the most common MDR mechanisms (MDR1/gp170 and MRP/gp180), and cancer cells can become resistant to these agents, the Illudins, Syn-illudins, and Acylfulvenes remain active against all MDR phenotypes regardless of the mechanism (see FIG. 7 and Table XIV). Hence, if tumor cells have already developed multi-drug resistance prior to ADC with a conventional toxin, or during the administration of a course of the ADC, the ADC will have no efficacy. In contrast, ADCs developed with Illudins, Syn-illudins, or Acylfulvenes will continue to kill cancer cells.

The present invention is based on the unexpected discovery that acylfulvenes, can be conjugated directly to a linker, via a variety of peptide or non-peptide bonds, and are active as medicant delivery agents in vitro and in vivo. Similar to other medicant classes used to produce antibody medicant conjugates, the acylfulvenes can be conjugated to a linker that allows subsequent coupling to a monoclonal antibody. Surprisingly, unlike previous medicant classes such as the auristatins (MMAE, MMAF, dolstatin-10), the maytansines (DM1 or DM4), the irinotecans and their metabolites (SN38), the calicheamicins (17-DMAG), the pyrrolobenzodiazepines (SJG-136), the duocarmycins (CC-1065), many of the acylfulvene compounds do not require a linker and can be directly attached to a monoclonal antibody or fragment thereof by a variety of simple chemical reactions. In this sense, the lack of requirement for a linker or a spacer, the acylfulvene compounds are unique. They will directly form covalent bonds with reactive groups on an AM such as a monoclonal antibody. In addition, because of their very small size and extreme cytotoxicity the acylfulvenes can be coupled directly to very small molecular weight entities (or affinity moieties) that allow tumor specific cytotoxicity without the concomitant requirement of use of a monoclonal antibody. Examples include the ability to link illudins/acylfulvenes directly to steroids which allow the medicant-affinity complex to kill cells overexpressing a specific steroid receptor (such as estrogen- or progesterone-positive breast cancer cells) or even to be chemically coupled to various lipids. The small size and extreme cytotoxicity acylfulvenes allows direct coupling to peptides which can preferentially bind to tumor cells (integrin binding peptides) or display anti-angiogenic properties to hinder tumor invasion. The illudins/acylfulvenes can also be coupled to specific peptides which actually renders the medicant-affinity complex non-toxic until the peptide is cleaved by a protease secreted by tumor cells. An example includes PSA (prostate specific antigen) secreted by prostate adenocarcinoma cells. Again, unlike previous medicant classes such as the auristatins (MMAE, MMAF, dolstatin-10), the maytansines (DM1 or DM4), the irinotecans and their metabolites (SN38), the calicheamicins (17-DMAG), the pyrrolobenzodiazepines (SJG-136), the duocarmycins (CC-1065), the acylfulvene compounds do not require a linker and can be directly attached to a steroid or a peptide that will subsequently function as an AM and direct the associated complex to specific tumor cells. An acylfulvene is attached to either a Specific Binding Peptide or a peptide which if cleaved by a specific protease (see Table IX) such as PSA generates an entity which is cytotoxic (see Table VIII).

Trastuzumab emtansine (Genentech for Breast cancer) uses maytanasine derive DM-1, a stable non-cleavable linker. Brentuximab vedotin (Seattle Genetics/Takeda for Hodgkin's Lymphoma) uses auristatin MMAE to anti-CD30, an enzyme sensitive cleavable linker.

The malonic linker, maleimide linker and SMCC [succinimidyl 4-(N-maleimidomethyl)-cyclohexane-1-carboxylate] linker can form active intermediates that react with sulfhydryl groups on an antibody. SMCC has been used to bind maytansine derivative DM1 to the monoclonal antibody Herceptin. The AMC was internalized where the Herceptin was degraded by proteases and DM1 was released into the cytosol. Further, Sulfo-SMCC [sulfosuccinimidyloxycarbonyl-α-methyl-α-(2-pyridyldithio)toluene] forms an active intermediate that reacts with sulthydryl groups on an antibody. The resulting Sulfo-SMCC AMC is more water soluble than the SMCC AMC.

Compounds and Conjugates:

The present invention is drawn to a series of compounds and conjugates containing a Medicant moiety (M) linked via its C terminus to a LU (LU). The LU can operate to provide a suitable release of M.

In one group of embodiments, the invention provides Medicant Linker compounds having Formula I: LU-M (I) or a pharmaceutically acceptable salt or solvate thereof where the medicant loading is represented by p, the average number of medicant molecules per affinity (e.g., an antibody) (e.g. of Formula II, IIa, IIa'). Medicant loading may range from 1 to 20 Medicant units (M) per Affinity unit (e.g., Ab or in Ab). Compositions of Formula IIa and Formula IIa' include mixtures of antibodies conjugated with a range of medicants, from 1 to 20.

In some embodiments, p is from about 1 to about 8 Medicant units per Affinity unit. In some embodiments, p is 1. In some embodiments, p is from about 2 to about 8 Medicant units per Affinity unit. In some embodiments, p is from about 2 to about 6, 2 to about 5, or 2 to about 4 Medicant units per LU. In some embodiments, p is about 2, about 4, about 6 or about 8 Medicant units per Affinity unit.

The average number of Medicants units per Affinity unit in a preparation from a conjugation reaction may be characterized by conventional means such as mass spectroscopy, ELISA assay, and HPLC. The quantitative distribution of Affinity Medicant Linker conjugates in terms of p may also be determined. In some instances, separation, purification, and characterization of homogeneous Affinity Medicant Linker conjugates, where p is a certain value from Affinity Medicant Linker conjugates with other medicant loadings may be achieved by means such as reverse phase HPLC or electrophoresis.

Returning to Formula IIa', the conjugates comprise an antibody covalently attached to one or more Medicant units (moieties) via a LU: A, a, W and w are as described above. The antibody medicant conjugate include pharmaceutically acceptable salts or solvates thereof.

The medicant loading is represented by p, the average number of Medicant units per antibody in a molecule of Formula II. Medicant loading may range from 1 to 20 medicants (M) per Ab or mAb. Compositions of the AMC of Formula IIa' include mixtures of antibodies conjugated with a range of medicants, from 1 to 20. In some embodiments, p is from about 1 to about 8 Medicant units per antibody. In some embodiments, p is 1. In some embodiments, p is from about 2 to about 8 Medicant units per antibody. In some embodiments, p is from about 2 to about 6, 2 to about 5, or 2 to about 4 Medicant units per antibody. In some embodiments, p is about 2, about 4, about 6 or about 8 Medicant units per antibody.

The average number of medicants per antibody in preparations of AMCs from conjugation reactions may be characterized by conventional means such as UV/visible spectroscopy, mass spectrometry, ELISA assay, and HPLC. The quantitative distribution of AMCs in terms of p may also be determined. In some instances, separation, purification, and characterization of homogeneous AMCs where p is a certain value from AMC with other medicant loadings may be achieved by means such as reverse phase HPLC or electrophoresis.

For some antibody medicant conjugates, p may be limited by the number of attachment sites on the antibody. For example, where the attachment is a cysteine thiol, an antibody may have only one or several cysteine thiol groups, or may have only one or several sufficiently reactive thiol groups through which a LU may be attached. In some embodiments, the cysteine thiol is a thiol group of a cysteine residue that forms an interchain disulfide bond. In some embodiments, the cysteine thiol is a thiol group of a cysteine residue that does not form an interchain disulfide bond.

Typically, less than the theoretical maximums of medicant moieties are conjugated to an antibody during a conjugation reaction. An antibody may contain, for example, many lysine residues that do not react with the Medicant Linker compound intermediate or LU reagent. Only the most reactive lysine groups may react with an amine-reactive LU reagent. Generally, antibodies do not contain many, if any, free and reactive cysteine thiol groups which may be linked to a Medicant moiety via a LU. Most cysteine thiol residues in the antibodies exist as disulfide bridges and must be reduced with a reducing agent such as dithiothreitol (DT). The antibody may be subjected to denaturing conditions to reveal reactive nucleophilic groups such as lysine or cysteine. The loading (medicant/antibody ratio) of an AMC may be controlled in several different manners, including: (i) limiting the molar excess of Medicant Linker compound intermediate or LU reagent relative to antibody, (ii) limiting the conjugation reaction time or temperature, and (iii) partial or limiting reductive conditions for cysteine thiol modification.

Where more than one nucleophilic group reacts with a Medicant Linker compound intermediate, or LU reagent followed by Medicant moiety reagent, then the resulting product is a mixture of Affinity Medicant Linker Conjugates (e.g., AMCs) with a distribution of one or more Medicant moieties per Affinity unit (e.g., an antibody). The average number of medicants per Affinity unit (e.g., antibody) may be calculated from the mixture by, for example, dual enzyme linked immune serum assay (ELISA) antibody assay, specific for antibody and specific for the medicant. Individual Affinity Medicant Linker Conjugate molecules may be identified in the mixture by mass spectroscopy, and separated by high performance liquid chromatography (HPLC), e.g., hydrophobic interaction chromatography. Thus, a homogeneous conjugate with a single loading value may be isolated from the conjugation mixture by electrophoresis or chromatography.

A "Linker Unit" (LU) is a bifunctional compound which can be used to link a Medicant unit and/or an Affinity unit to form an Affinity Medicant Linker conjugate. Such conjugates are useful, for example, in the formation of immuno conjugates directed against tumor associated antigens. Such conjugates allow the selective delivery of cytotoxic drugs to tumor cells. A LU includes a traditional linker, a 4-fluorosulfonyl benzoyl (4-FSB) linker, a 3-fluorosulfonyl benzoyl (3-FSB) linker a 2-fluorosulfonyl benzoyl (2-FSB) linker, a maleimide (Mall) linker, an azlactone linker and a bridging amino acid.

A traditional linker is a linker as defined in Table I through Table VI, where the reagent column identifies various traditional linkers. A Stretcher Unit includes two or more Linker Units.

A bridging amino acid means —NH—C(R')H—CO— or —N(R")—C(R')H—CO— including glycine, L-alanine, L-serine, L-threonine, L-cysteine, L-valine, L-leucine, L-isoleucine, L-methionine, L-proline, L-phenylalanine, L-tyrosine, L-tryptophan, L-aspartic acid, L-glutamic acid, L-asparagine, L-glutamine, L-histidine, L-lysine, L-arginine, L-homocysteine, L-selenocysteine, L-pyrrolysine, L-carnitine, L-hypusine, 2-aminoisobutyric acid, dehydroalanine, L-gamma-aminobutyric acid, L-ornithine, L-citrulline, L-α-Amino-n-butyric acid, L-Norvaline, L-Norleucine, L-Pipecolic acid, L-Alloisoleucine, L-α,β-diaminopropionic acid, L-α,γ-diaminobutyric acid, L-Allothreonine, L-α-Amino-n-heptanoic acid, L-Homoserine, β-Amino-n-butyric acid, β-Aminoisobutyric acid, γ-Aminobutyric acid, L-isovaline, L-Sarcosine, N-ethyl glycine, N-propyl glycine, N-isopropyl glycine, L-N-methyl alanine, L-N-ethyl alanine, N-methyl β-alanine, N-ethyl β-alanine, Isoserine, L-α-hydroxy-γ-aminobutyric acid, L-diaminopimelic acid, cystathione, L-aminoisobutyric acid, dehydroalanine, delta-aminolevulinic acid, 4-aminobenzoic acid, L-Hydroxyproline, Formylmethioinine, L-lanthionine, djenkolic acid, L-Pyroglutamic acid, Hypusine, L-carboxyglutamic acid, penicillamine, L-thialysine, quisqualic acid, L-canavine, L-azetidine-2-carboxylic acid, D-alanine, D-serine, D-threonine, D-cysteine, D-valine, D-leucine, D-isoleucine, D-methionine, D-proline, D-phenylalanine, D-tyrosine, D-tryptophan, D-aspartic acid, D-glutamic acid, D-asparagine, D-glutamine, D-histidine, D-lysine, D-arginine, D-homocysteine, D-selenocysteine, D-pyrrolysine, D-carnitine, D-hypusine, D-gamma-aminobutyric acid, D-ornithine, D-citrulline, D-α-Amino-n-butyric acid, D-Norvaline, D-Norleucine, D-Pipecolic acid, D-Alloisoleucine, D-α,β-diaminopropionic acid, D-α,γ-diaminobutyric acid, D-Allothreonine, D-α-Amino-n-heptanoic acid, D-Homoserine, D-isovaline, D-Sarcosine, D-N-methyl alanine, D-N-ethyl alanine, D-α-hydroxy-γ-aminobutyric acid, D-diaminopimelic acid, D-aminoisobutyric acid, D-Hydroxyproline, D-lanthionine, D-Pyroglutamic acid, D-carboxyglutamic acid, D-thialysine, quisqualic acid, D-canavine, D-azetidine-2-carboxylic acid. A 'modified bridging amino acid' means a bridging amino acid with R' including a hydroxyl group that has been esterified, a bridging amino acid with R' including a sulphur atom where the sulphur atom has been reacted with an alkyl or other organic group and/or a bridging amino acid with R' including a primary amino group that has been converted into a secondary or tertiary amino group.

In one embodiment, the LU of the Medicant Linker compound and Affinity Medicant Linker conjugate has the formula: —$W_w$-$A_a$ wherein -A- is a Stretcher Unit; a is 1 or 2; each —W— is independently an Amino Acid unit; w is independently an integer ranging from 1 to 20. In the Affinity Medicant Linker conjugate, the LU serves to attach the Medicant moiety and the AM.

The Affinity Moiety (AM) includes within its scope an Affinity Unit (AU) that specifically binds or reactively associates or complexes with a receptor, antigen or other receptive moiety associated with a given target-cell population. An AU is a molecule that binds to, complexes with, or reacts with a receptor, antigen or other receptive moiety of a cell population sought to be therapeutically or otherwise biologically modified. In one aspect, the AM acts to deliver the Medicant unit to the particular target cell population with which the AM interacts. Such AM's include, but are not limited to, proteins, polypeptides and peptides and include, antibodies, binding proteins, smaller molecular weight proteins, polypeptides, peptides, lectins, glycoproteins, non-peptides, vitamins, nutrient-transport molecules (such as, but not limited to, transferrin), or any other cell binding molecule or substance.

In an embodiment of the invention, an AM can form a bond to a Stretcher Unit. In an alternative embodiment of the invention, an AM can form a bond to the Stretcher Unit of the LU via a heteroatom of the AM. Heteroatoms that may be present on an AM include sulfur (in one embodiment, from a sulfhydryl group of an AM), oxygen (in one embodiment, from a carbonyl, carboxyl or hydroxyl group of an AM) and nitrogen (in one embodiment, from a primary or secondary amino group of an AM). These hetero atoms can be present on the AM in the AM's natural state, for example a naturally-occurring antibody, or can be introduced into the AM via chemical modification.

In one embodiment, an AM unit has a sulfhydryl group and the AM bonds to the LU via the sulfhydryl group's sulfur atom. In another embodiment, the AM has lysine residues that can react with activated esters (such esters include, but are not limited to, N-hydroxysuccinimide, pentafluorophenyl, and p-nitrophenyl esters) of the Stretcher Unit of the AM and thus form an amide bond consisting of the primary nitrogen atom of the AM and the carboxyl group of the AM. In yet another aspect, the AM has one or more lysine residues that can be chemically modified to introduce one or more sulfhydryl groups. The AM bonds to the LU via the sulfhydryl group's sulfur atom. The reagents that can be used to modify lysines include, but are not limited to, N-succinimidyl S-acetylthioacetate (SATA) and 2-Iminothiolane hydrochloride (Traut's Reagent).

In another embodiment, the AM can have one or more carbohydrate groups that can be chemically modified to have one or more sulfhydryl groups. The AM bonds to the LU (or a Stretcher Unit) via the sulfhydryl group's sulfur atom. In yet another embodiment, the AM can have one or more carbohydrate groups that can be oxidized to provide an aldehyde (—CHO) group. The corresponding aldehyde can form a bond with a reactive site on a Stretcher Unit. Reactive sites on a Stretcher Unit that can react with a carbonyl group on an AM include, but are not limited to, hydrazine and hydroxylamine.

Useful non-immunoreactive protein, polypeptide, or peptide affinity moieties include, but are not limited to, transferrin, epidermal growth factors ("EGF"), bombesin, gastrin, gastrin-releasing peptide, platelet-derived growth factor, IL-2, IL-6, transforming growth factors ("TOP"), such as TGF-.alpha. and TGF-.beta., vaccinia growth factor ("VGF"), insulin and insulin-like growth factors I and II, somatostatin, lectins and apoprotein from low density lipoprotein.

Useful polyclonal antibodies are heterogeneous populations of antibody molecules derived from the sera of immunized animals. Useful monoclonal antibodies are homogeneous populations of antibodies to a particular antigenic determinant (e.g., a cancer cell antigen, a viral antigen, a microbial antigen, a protein, a peptide, a carbohydrate, a chemical, nucleic acid, or fragments thereof). A monoclonal antibody (mAb) to an antigen-of-interest can be prepared by using any technique known in the art which provides for the production of antibody molecules by continuous cell lines in culture.

Useful monoclonal antibodies include, but are not limited to, human monoclonal antibodies, humanized monoclonal antibodies, antibody fragments, or chimeric monoclonal antibodies. Human monoclonal antibodies may be made by any of numerous techniques known in the art.

The antibody can also be a bispecific antibody. Methods for making bispecific antibodies ae known in the at and are discussed infra.

The antibody can be a functionally active fragment, derivative or analog of an antibody that immunospecifically binds to target cells (e.g., cancer cell antigens, viral antigens, or microbial antigens) or other antibodies that bind to tumor cells or matrix. In this regard, "functionally active" means that the fragment, derivative or analog is able to elicit anti-anti-idiotype antibodies that recognize the same antigen that the antibody from which the fragment, derivative or analog is derived recognized. Specifically, in an exemplary embodiment the antigenicity of the idiotype of the immunoglobulin molecule can be enhanced by deletion of framework and CDR sequences that are C-terminal to the CDR sequence that specifically recognizes the antigen. To determine which CDR sequences bind the antigen, synthetic peptides containing the CDR sequences can be used in binding assays with the antigen by any binding assay method known in the art (e.g., the BIA core assay).

Other useful antibodies include fragments of antibodies such as, but not limited to, $F(ab')_2$ fragments, Fab fragments, Fvs, single chain antibodies, diabodies, triabodies, tetrabodies, scFv, scFv-FV, or any other molecule with the same specificity as the antibody.

Additionally, recombinant antibodies, such as chimeric and humanized monoclonal antibodies, comprising both human and non-human portions, which can be made using standard recombinant DNA techniques, are useful antibodies. A chimeric antibody is a molecule in which different portions are derived from different animal species, such as for example, those having a variable region derived from a murine monoclonal and human immunoglobulin constant regions. Humanized antibodies are antibody molecules from non-human species having one or more complementarity determining regions (CDRs) from the non-human species and a framework region from a human immunoglobulin molecule. Such chimeric and humanized monoclonal antibodies can be produced by recombinant DNA techniques known in the art.

Completely human antibodies are particularly desirable and can be produced using transgenic mice that are incapable of expressing endogenous immunoglobulin heavy and light chains genes, but which can express human heavy and light chain genes. The transgenic mice are immunized in the normal fashion with a selected antigen, e.g., all or a portion of a polypeptide of the invention. Monoclonal antibodies directed against the antigen can be obtained using conventional hybridoma technology. The human immunoglobulin transgenes harbored by the transgenic mice rearrange during B cell differentiation, and subsequently undergo class switching and somatic mutation. Thus, using such a technique, it is possible to produce therapeutically useful IgO, IgA, IgM and IgE antibodies. Other human antibodies can be obtained commercially from, for example, Abgenix, Inc. (now Amgen, Freemont, Calif.) and Medarex (Princeton, N.J.).

Completely human antibodies that recognize a selected epitope can be generated using a technique referred to as "guided selection." In this approach a selected non-human monoclonal antibody, e.g., a mouse antibody, is used to guide the selection of a completely human antibody recognizing the same epitope. Human antibodies can also be produced using various techniques known in the art, including phage display libraries.

In other embodiments, the antibody is a fusion protein of an antibody, or a functionally active fragment thereof, for example in which the antibody is fused via a covalent bond (e.g., a peptide bond), at either the N-terminus or the C-terminus to an amino acid sequence of another protein (or portion thereof, preferably at least 10, 20 or 50 amino acid portion of the protein) that is not from an antibody. Preferably, the antibody or fragment thereof is covalently linked to the other protein at the N-terminus of the constant domain.

Antibodies include analogs and derivatives that are either modified, i.e., by the covalent attachment of any type of molecule as long as such covalent attachment permits the antibody to retain its antigen binding immunospecificity. For example, but not by way of limitation, derivatives and analogs of the antibodies include those that have been further modified, e.g., by glycosylation, acetylation, pegylation, phosphorylation, amidation, derivatization by known protecting/blocking groups, proteolytic cleavage, linkage to a cellular antibody unit or other protein, etc. Any of numerous chemical modifications can be carried out by known techniques including, but not limited to, specific chemical cleavage, acetylation, formylation, metabolic synthesis in the presence of tunicamycin, etc. Additionally, the analog or derivative can contain one or more unnatural amino acids.

Antibodies can have modifications (e.g., substitutions, deletions or additions) in amino acid residues that interact with Fc receptors. In particular, antibodies can have modifications in amino acid residues identified as involved in the interaction between the anti-Fc domain and the FcRn receptor.

Antibodies immunospecific for a cancer cell antigen can be obtained commercially or produced by any method known to one of skill in the art such as, e.g., chemical synthesis or recombinant expression techniques. The nucleotide sequence encoding antibodies immunospecific for a cancer cell antigen can be obtained, e.g., from the GenBank database or a database like it, literature publications, or by routine cloning and sequencing.

In a specific embodiment, known antibodies for the treatment of cancer can be used. Antibodies immunospecific for a cancer cell antigen can be obtained commercially or produced by any method known to one of skill in the art such as, e.g., recombinant expression techniques. The nucleotide sequence encoding antibodies immunospecific for a cancer cell antigen can be obtained, e.g., from the GenBank database or a database like it, the literature publications, or by routine cloning and sequencing. Examples of antibodies available for the treatment of cancer include, but are not limited to, RITUXAN® (rituximab; Genentech) which is a chimeric anti-CD20 monoclonal antibody for the treatment of patients with non-Hodgkin's lymphoma; OVAREX which is a murine antibody for the treatment of ovarian cancer; PANOREX (Glaxo Wellcome, N.C.) which is a murine $IgG_2$, antibody for the treatment of colorectal cancer; Cetuximab ERBITUX (Imclone Systems Inc., NY) which is an anti-EGFR IgG chimeric antibody for the treatment of epidermal growth factor positive cancers, such as head and neck cancer; Vitaxin (MedImmune, Inc., MD) which is a humanized antibody for the treatment of sarcoma; CAMPATH I/H (Leukosite, MA) which is a humanized IgG, antibody for the treatment of chronic lymphocytic leukemia (CLL); SMART M195 (Protein Design Labs, Inc., CA) and SGN-33 (Seattle Genetics, Inc., WA) which is a humanized anti-CD33 IgG antibody for the treatment of acute myeloid leukemia (AML); LYMPHOCIDE (Immunomedica, Inc., NJ) which is a humanized anti-CD22 IgO antibody for the treatment of non-Hodgkin's lymphoma; SMART ID10 (Protein Design Labs, Inc., CA) which is a humanized anti-HLA-DR antibody for the treatment of non-Hodgkin's lymphoma; ONCOLYM (Techniclone, Inc., CA) which is a radiolabeled murine anti-HLA-Dr10 antibody for the treatment of non-Hodgkin's lymphoma; ALLOMUNE (BioTransplant, CA) which is a humanized anti-CD2 mAb for the treatment of Hodgkin's Disease or non-Hodgkin's lymphoma; AVASTIN (Genentech, Inc., CA) which is an anti-VEGF humanized antibody for the treatment of lung and colorectal cancers; Epratuzamab (Immunomedics, Inc., NJ and Amgen, Calif.) which is an anti-CD22 antibody for the treatment of non-Hodgkin's lymphoma; and CEACIDE (Immunomedics, N.J.) which is a humanized anti-CEA antibody for the treatment of colorectal cancer.

Other antibodies useful in the treatment of cancer include, but are not limited to, antibodies against the following antigens (where exemplary cancers that can be treated with the antibody are in parentheses): Alk (adrenocarcinomas) (SEQ. ID. 103), CA125 (ovarian) (SEQ. ID. 104), CA15-3 (carcinomas) (SEQ. ID. 105), CA19-9 (carcinomas), L6 (carcinomas) (SEQ. ID. 107), Lewis Y (carcinomas) (SEQ. ID. 108), Lewis X (carcinomas) (SEQ. ID. 109), alpha fetoprotein (carcinomas) (SEQ. ID. 110), CA 242 (colorectal), placental alkaline phosphatase (carcinomas) (SEQ. ID. 112), prostate specific antigen (prostate) (SEQ. ID. 113), prostate specific membrane antigen (prostate) (SEQ. ID. 114), prostatic acid phosphatese (prostate) (SEQ. ID. 115), epidermal growth factor (carcinomas), MAGE-1 (carcinomas) (SEQ. ID. 117), MAGE-2 (carcinomas) (SEQ. ID. 118), MAGE-3 (carcinomas) (SEQ. ID. 119), MAGE-4 (carcinomas) (SEQ. ID. 120), anti-transferrin receptor (carcinomas) (SEQ. ID. 121), p97 (melanoma) (SEQ. ID. 122), MUC1 (breast cancer) (SEQ. ID. 123), CEA (colorectal) (SEQ. ID. 124), gp100 (melanoma) (SEQ. ID. 125), MART-1 (melanoma) (SEQ. ID. 126), IL-2 receptor (T-cell leukemia and lymphomas), CD2 (buccal mucosa) (SEQ. ID. 128), CD20 (non-Hodgkin's lymphoma) (SEQ. ID. 129), CD52 (leukemia) (SEQ. ID. 130), CD33 (leukemia), CD22 (lymphoma), beta human chorionic gonadotropin (carcinoma) (SEQ. ID. 133), CD38 (multiple myeloma) (SEQ. ID. 134), CD40 (lymphoma) (SEQ. ID. 135), CD80 (colorectal), CD86 (colorectal), mucin (carcinomas), P21 (carcinomas), MPG (melanoma) (SEQ. ID. 140), Neu oncogene product (carcinomas) and STEAP-1 (prostate).

Compositions and Methods of Administration.

In other embodiments, described is a pharmaceutical composition including an effective amount of an Affinity Medicant Linker conjugate and/or a Medicant Linker compound and a pharmaceutically acceptable carrier or vehicle. The compositions are suitable for veterinary or human administration.

The present pharmaceutical compositions can be in any form that allows for the composition to be administered to a patient. For example, the composition can be in the form of a solid or liquid. Typical mutes of administration include, without limitation, parenteral, ocular and intra-tumor. Parenteral administration includes subcutaneous injections, intravenous, intramuscular or intrasternal injection or infusion techniques. In one aspect, the compositions are administered parenterally. In a specific embodiment, the compositions are administered intravenously.

Pharmaceutical compositions can be formulated so as to allow an Affinity Medicant Linker conjugate and/or a Medicant Linker compound to be bioavailable upon administration of the composition to a patient. Compositions can take the form of one or more dosage units, where for example, a tablet can be a single dosage unit, and a container of an Affinity Medicant Linker conjugate and/or a Medicant Linker compound in liquid form can hold a plurality of dosage units.

Materials used in preparing the pharmaceutical compositions can be non-toxic in the amounts used. It will be evident to those of ordinary skill in the art that the optimal dosage of the active ingredient(s) in the pharmaceutical composition will depend on a variety of factors. Relevant factors include, without limitation, the type of animal (e.g., human), the particular form of the Affinity Medicant Linker conjugate and/or a Medicant Linker compound, the manner of administration, and the composition employed.

The pharmaceutically acceptable carrier or vehicle can be solid or particulate, so that the compositions are, for example, in tablet or powder form. The carrier(s) can be liquid. In addition, the carrier(s) can be particulate.

The composition can be in the form of a liquid, e.g., a solution, emulsion or suspension. In a composition for administration by injection, one or more of a surfactant, preservative, wetting agent, dispersing agent, suspending agent, buffer, stabilizer and isotonic agent can also be included.

The liquid compositions, whether they are solutions, suspensions or other like form, can also include one or more of the following: sterile diluents such as water for injection, saline solution, preferably physiological saline, Ringers solution, isotonic sodium chloride, fixed oils such as synthetic mono or diglycerides which can serve as the solvent or suspending medium, polyethylene glycols, glycerin, cyclodextrin, propylene glycol or other solvents; antibacterial agents such as benzyl alcohol or methyl paraben; antioxidants such as ascorbic acid or sodium bisulfite; chelating agents such as ethylenediaminetetraacetic acid; buffers such as acetates, citrates, phosphates or amino acids and agents for the adjustment of tonicity such as sodium chloride or dextrose. A parenteral composition can be enclosed in ampoule, a disposable syringe or a multiple-dose vial made of glass, plastic or other material. Physiological saline is an exemplary adjuvant. An injectable composition is preferably sterile.

The amount of the Affinity Medicant Linker conjugate and/or a Medicant Linker compound that is effective in the treatment of a particular disorder or condition will depend on the nature of the disorder or condition, and can be determined by standard clinical techniques. In addition, in vitro or in vivo assays can optionally be employed to help identify optimal dosage ranges. The precise dose to be employed in the compositions will also depend on the route of administration, and the seriousness of the disease or disorder, and should be decided according to the judgment of the practitioner and each patient's circumstances.

The compositions comprise an effective amount of an Affinity Medicant Linker conjugate and/or a Medicant Linker compound such that a suitable dosage will be obtained. Typically, this amount is at least about 0.01% of an Affinity Medicant Linker conjugate and/or a Medicant Linker compound by weight of the composition. In an exemplary embodiment, pharmaceutical compositions are prepared so that a parenteral dosage unit contains from about 0.01% to about 2% by weight of the Affinity Medicant Linker conjugate and/or a Medicant Linker compound.

For intravenous administration, the composition can comprise from about 0.01 to about 100 mg of an Affinity Medicant Linker conjugate and/or a Medicant Linker compound per kg of the patient's body weight. In one aspect, the composition can include from about 1 to about 100 mg of an Affinity Medicant Linker conjugate and/or a Medicant Linker compound per kg of the patient's body weight. In another aspect, the amount administered will be in the range from about 0.1 to about 25 mg/kg of body weight of the Affinity Medicant Linker conjugate and/or a Medicant Linker compound.

Prior art ADC's such as Kadcyla or Adcetris deliver a dose of the associated toxin (auristatins MMAE or emtansine DM-1) that is three or more times the lethal dose (for that toxin) which results in severe systemic (or non-target) toxicity. In contrast, Illudin and Acylfulvene ADC's (such as analog 189, analog 190), analog 217, analog 218, analog 219, analog 222, or analog 316 deliver less than one third (i.e., <⅓) of a lethal dose, minimizing the risk and severity of systemic toxicity. Illudins and Acylfulvenes are true cytotoxic agents whereas other toxic agents used in prior art ADC's (e.g., pyrrolobenzodiazepines, maytansines, fumagillols, dolstatins, auristatins, enadiynes, helichondrins, and tubulysins) are only cytostatic. See Table XIII (the NCI-DTP 60 cell line table). Hence, other payloads, such as those used in Herceptin, Adcetris or Rituxin only stall tumor cell growth and do not actually kill the tumor cells. Other payloads (e.g., pyrrolobenzodiazepines, maytansines, fumagillols, dolstatins, auristatins, enadiynes, halichondrins, and tubulysins) are not active against multidrug phenotypes, notably the MDR1/GP170 and MRP/GP180 transport mechanisms (see Table XIV). Illudins and Acylfulvenes show the excellent effect of remaining active against all MDR phenotypes known regardless of the mechanism of resistance (see Table XIV). Hence, if tumor cells have already developed multi-drug resistance to a prior art ADC with a prior at toxin, or develop multi-drug resistance during the administration of a course of the prior art ADC with a prior art toxin, then the ADC will have no efficacy. In contrast, ADCs developed with Illudins, Syn-illudins, or Acylfulvenes have the advantageous effect that they will continue to kill cancer cells.

Generally, the dosage of an Affinity Medicant Linker conjugate and/or a Medicant Linker compound administered to a patient is typically about 0.01 mg/kg to about 20 mg/kg of the patient's body weight. In one aspect, the dosage administered to a patient is between about 0.01 mg/kg to about 10 mg/kg of the patient's body weight. In another aspect, the dosage administered to a patient is between about 0.1 mg/kg and about 10 mg/kg of the patient's body weigh. In yet another aspect, the dosage administered to a patient is between about 0.1 mg/kg and about 5 mg/kg of the patient's body weight. In yet another aspect the dosage administered is between about 0.1 mg/kg to about 3 mg/kg of the patient's body weight. In yet another aspect, the dosage administered is between about 1 mg/kg to about 3 mg/kg of the patient's body weight.

The Affinity Medicant Linker conjugate and/or a Medicant Linker compound can be administered by any convenient route, for example by infusion or bolus injection. Administration can be systemic or local. Various delivery systems are known, e.g., encapsulation in liposomes, microparticles, microcapsules, capsules, etc., and can be used to administer an Affinity Medicant Linker conjugate and/or a Medicant Linker compound. In certain embodiments, more than one Affinity Medicant Linker conjugate and/or a Medicant Linker compound is administered to a patient.

In specific embodiments, it can be desirable to administer one or more Affinity Medicant Linker conjugates and/or a Medicant Linker compound locally to the area in need of treatment. This can be achieved, for example, and not by way of limitation, by local infusion during surgery; topical application, e.g., in conjunction with a wound dressing after surgery; by injection; by means of a catheter; or by means of an implant, the implant being of a porous, non-porous, or gelatinous material, including membranes, such as sialastic membranes, or fibers. In one embodiment, administration can be by direct injection at the site (or former site) of a cancer, tumor or neoplastic or pre-neoplastic tissue. In another embodiment, administration can be by direct injection at the site (or former site) of a manifestation of an autoimmune disease.

In yet another embodiment, the Affinity Medicant Linker conjugate and/or a Medicant Linker compound can be delivered in a controlled release system, such as but not limited to, a pump or various polymeric materials can be used. In yet another embodiment, a controlled-release system can be placed in proximity of the target of the Linker Affinity conjugate and/or a Medicant Linker compound, e.g., the liver, thus requiring only a fraction of the systemic dose.

The term "carrier" refers to a diluent, adjuvant or excipient, with which an Affinity Medicant Linker conjugate and/or a Medicant Linker compound is administered. Such pharmaceutical carriers can be liquids, such as water and oils, including those of petroleum, animal, vegetable or synthetic origin. The carriers can be saline, and the like. In addition, auxiliary, stabilizing and other agents can be used. In one embodiment, when administered to a patient, the Affinity Medicant Linker conjugate and/or the Medicant Linker compound and pharmaceutically acceptable carriers are sterile. Water is an exemplary carrier when the Affinity Medicant Linker conjugate and/or a Medicant Linker compound are administered intravenously. Saline solutions and aqueous dextrose and glycerol solutions can also be employed as liquid carriers, particularly for injectable solutions. The present compositions, if desired, can also contain minor amounts of wetting or emulsifying agents, or pH buffering agents.

The present compositions can take the form of solutions, pellets, powders, sustained-release formulations, or any other form suitable for use.

In an embodiment, the Affinity Medicant Linker conjugates and/or Medicant Linker compounds are formulated in accordance with routine procedures as a pharmaceutical composition adapted for intravenous administration to animals, particularly human beings. Typically, the carriers or vehicles for intravenous administration are sterile isotonic aqueous buffer solutions. Where necessary, the compositions can also include a solubilizing agent. Compositions for intravenous administration can optionally comprise a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where an Affinity Medicant Linker conjugate and/or Medicant Linker compound is to be administered by infusion, it can be dispensed, for example, with an infusion bottle containing sterile pharmaceutical grade water or saline. Where the Affinity Medicant Linker conjugate and/or Medicant Linker compound is administered by injection, an ampoule of sterile water for injection or saline can be provided so that the ingredients can be mixed prior to administration.

The composition can include various materials that modify the physical form of a solid or liquid dosage unit. For example, the composition can include materials that form a coating shell around the active ingredients. The materials that form the coating shell are typically inert, and can be selected from, for example, sugar, shellac, and other enteric coating agents. Alternatively, the active ingredients can be encased in a gelatin capsule.

Whether in solid or liquid form, the present compositions can include a pharmacological agent used in the treatment of cancer, an autoimmune disease or an infectious disease.

Treatment of Cancer.

The Affinity Medicant Linker conjugates and Medicant Linker compounds are useful for inhibiting the multiplication of a tumor cell or cancer cell, causing apoptosis in a tumor or cancer cell, or for treating cancer in a patient. The Affinity Medicant Linker conjugates and/or Medicant Linker compounds can be used accordingly in a variety of settings for the treatment of animal cancers. The Affinity Medicant Linker Conjugates can be used to deliver a Medicant or Medicant unit to a tumor cell or cancer cell. Without being bound by theory, in one embodiment, the AM of an Affinity Medicant Linker conjugate binds to or associates with a cancer-cell or a tumor-cell-associated antigen, and the Affinity Medicant Linker conjugate can be taken up (internalized) inside a tumor cell or cancer cell through receptor-mediated endocytosis or other internalization mechanism. The antigen can be attached to a tumor cell or cancer cell or can be an extracellular matrix protein associated with the tumor cell or cancer cell. Once inside the cell, one or more specific peptide sequences within or at the Medicant unit's proximal end of the LU are hydrolytically cleaved by one or more tumor cell or cancer cell-associated proteases, resulting in release of the Medicant unit. The released Medicant unit is then free to migrate within the cell and induce cytotoxic or cytostatic activities. The Affinity Medicant Linker conjugate also can be cleaved by an intracellular protease to release the Medicant moiety. In an alternative embodiment, the Medicant or Medicant unit is cleaved from the Affinity Medicant Linker conjugate outside the tumor cell or cancer cell, and the Medicant or Medicant unit subsequently penetrates the cell.

The Affinity Medicant Linker conjugates provide conjugation-specific tumor or cancer medicant targeting, thus reducing general toxicity of the Medicant. The LUs stabilize the Affinity Medicant Conjugates in blood, yet are cleavable by tumor-specific proteases within the cell, liberating a Medicant unit.

In one embodiment, the AM binds to the tumor cell or cancer cell. In another embodiment, the AM binds to a tumor cell or cancer cell antigen which is on the surface of the tumor cell or cancer cell. In another embodiment, the AM binds to a tumor cell or cancer cell antigen which is an extracellular matrix protein associated with the tumor cell or cancer cell.

The specificity of the AM for a particular tumor cell or cancer cell can be important for determining those tumors or cancers that are most effectively treated. For example, an Affinity Medicant Linker conjugate and/or Medicant Linker compound having a BR96 AM can be useful for treating antigen positive carcinomas including those of the lung, breast, colon, ovaries, and pancreas. Affinity Medicant Linker conjugates having an anti-CD30 or an anti-CD70 binding affinity moiety can be useful for treating hematologic malignancies.

Other particular types of cancers that can be treated with an Affinity Medicant Linker conjugate and/or a Medicant Linker compound include, but are not limited to fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, colon cancer, colorectal cancer, kidney cancer, pancreatic cancer, bone cancer, breast cancer, ovarian cancer, prostate cancer, esophageal cancer, stomach cancer, oral cancer, nasal cancer, throat cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilms' tumor, cervical cancer, uterine cancer, testicular cancer, small cell lung carcinoma, bladder carcinoma, lung cancer, epithelial carcinoma, glioma, glioblastoma multiforme, astrocytoma, medulloblastoma, craniopharyngioma, ependymoma, pinealoma, hemangioblastoma, acoustic neuroma, oligodendroglioma, meningioma, skin cancer, melanoma, neuroblastoma, retinoblastoma blood-borne cancers, including but not limited to: acute lymphoblastic leukemia "ALL", acute lymphoblastic B-cell leukemia, acute lymphoblastic T-cell leukemia, acute myeloblastic leukemia "AML", acute promyelocytic leukemia "APL", acute monoblastic leukemia, acute erythroleukemic leukemia, acute megakaryoblastic leukemia, acute myelomonocytic leukemia, acute nonlymphocytic leukemia, acute undifferentiated leukemia, chronic myelocytic leukemia "CML", chronic lymphocytic leukemia "CLL", hairy cell leukemia, multiple myeloma acute and chronic leukemias: lymphoblastic, myelogenous, lymphocytic, myelocytic leukemias Lymphomas: Hodgkin's disease, non-Hodgkin's Lymphoma. Multiple myeloma, Waldenstrom's macroglobulinemia, Heavy chain disease, Polycythemia vera.

Multi-Modality Therapy for Cancer.

Cancers, including, but not limited to, a tumor, metastasis, or other disease or disorder characterized by uncontrolled cell growth, can be treated or inhibited by administration of an Affinity Medicant Linker conjugate or Medicant Linker compound.

In other embodiments, methods for treating cancer are provided, including administering to a patient in need thereof an effective amount of an Affinity Medicant Linker conjugate and a chemotherapeutic agent. In one embodiment the chemotherapeutic agent is that with which treatment of the cancer has not been found to be refractory. In another embodiment, the chemotherapeutic agent is that with which the treatment of cancer has been found to be refractory. The Affinity Medicant Linker conjugates can be administered to a patient that has also undergone surgery as treatment for the cancer.

In some embodiments, the patient also receives an additional treatment, such as radiation therapy. In a specific embodiment, the Affinity Medicant Linker conjugate is administered concurrently with the chemotherapeutic agent or with radiation therapy. In another specific embodiment, the chemotherapeutic agent or radiation therapy is administered prior or subsequent to administration of an Affinity Medicant Linker conjugate.

A chemotherapeutic agent can be administered over a series of sessions. Any one or a combination of the chemotherapeutic agents, such a standard of care chemotherapeutic agent(s), can be administered.

Additionally, methods of treatment of cancer with an Affinity Medicant Linker conjugate and/or a Medicant Linker compound are provided as an alternative to chemotherapy or radiation therapy where the chemotherapy or the radiation therapy has proven or can prove too toxic, e.g., results in unacceptable or unbearable side effects, for the subject being treated. The patient being treated can, optionally, be treated with another cancer treatment such as surgery, radiation therapy or chemotherapy, depending on which treatment is found to be acceptable or bearable.

The Affinity Medicant Linker (AML) conjugates and/or Medicant Linker (ML) compounds can also be used in an in vitro or ex vivo fashion, such as for the treatment of certain cancers, including, but not limited to leukemia and lymphomas, such treatment involving autologous stem cell transplants. This can involve a multi-step process in which the animal's autologous hematopoietic stein cells are harvested and purged of all cancer cells, the animal's remaining bone-marrow cell population is then eradicated via the administration of a high dose of an AML conjugates and/or ML compound with or without accompanying high dose radiation therapy, and the stem cell graft is infused back into the animal. Supportive care is then provided while bone marrow function is restored and the patient recovers.

Treatment of Autoimmune Diseases.

The Affinity Medicant Linker conjugates and Medicant Linker compounds are useful for killing or inhibiting the replication of a cell that produces an autoimmune disease or for treating an autoimmune disease. The Affinity Medicant Linker conjugates and Medicant Linker compounds can be used accordingly in a variety of settings for the treatment of an autoimmune disease in a patient. The Affinity Medicant Linker conjugates can be used to deliver a Medicant unit to a target cell. Without being bound by theory, in one embodiment, the Affinity Medicant Linker conjugate associates with an antigen on the surface of a target cell, and the Affinity Medicant Linker conjugate is then taken up inside a target-cell through receptor-mediated endocytosis. Once inside the cell, one or more specific peptide sequences within and/or Medicant unit proximal to the LU are enzymatically or hydrolytically cleaved, resulting in release of the Medicant or Medicant unit. The released Medicant or Medicant unit is then free to migrate in the cytosol and induce cytotoxic or cytostatic activities. The Affinity Medicant Linker conjugate also can be cleaved by an intracellular protease to release the Medicant or Medicant moiety. In an alternative embodiment, the Medicant is cleaved from the Affinity Medicant Linker conjugate outside the target cell, and the Medicant or Medicant unit subsequently penetrates the cell.

In an embodiment of the present invention, the AM binds to an autoimmune antigen. In one aspect, the antigen is on the surface of a cell involved in an autoimmune condition. In another embodiment, the AM binds to an autoimmune antigen which is on the surface of a cell. In one embodiment, the AM binds to activated lymphocytes that are associated with the autoimmune disease state.

In a further embodiment, the Affinity Medicant Linker conjugate or Medicant Linker compound kills or inhibit the multiplication of cells that produce an autoimmune antibody associated with a particular autoimmune disease.

In various embodiments of the present invention, the AML or AM conjugates can be used to treat particular types of autoimmune diseases including, but not limited to, Th2 lymphocyte related disorders (e.g., atopic dermatitis, atopic asthma, rhinoconjunctivitis, allergic rhinitis, Omenn's syndrome, systemic sclerosis, and graft versus host disease); Thi lymphocyte-related disorders (e.g., rheumatoid arthritis, multiple sclerosis, psoriasis, Sjorgren's syndrome, Hashimoto's thyroiditis, Grave's disease, primary biliary cirrhosis, Wegener's granulomatosis, and tuberculosis); activated B lymphocyte-related disorders (e.g., systemic lupus erythematosus, Goodpasture's syndrome, rheumatoid arthritis, and type I diabetes): and Active Chronic Hepatitis, Addison's Disease, Allergic Alveolitis, Allergic Reaction, Allergic Rhinitis, Alport's Syndrome, Anaphlaxis, Ankylosing Spondylitis, Anti-phosholipid Syndrome, Arthritis, Ascariasis, Aspergillosis, Atopic Allergy, Atropic Dermatitis, Atropic Rhinitis, Behcet's Disease, Bird-Fancier's Lung, Bronchial Asthma, Caplan's Syndrome, Cardiomyopethy. Celiac Disease, Chagas' Disease, Chronic Glomerulonephritis, Cogan's Syndrome, Cold Agglutinin Disease, Congenital Rubella Infection, CREST Syndrome, Crohn's Disease, Cryoglobulinemia, Cushing's Syndrome, Dermatomyositis, Discoid Lupus, Dressler's Syndrome, Eaton-Lambert Syndrome, Echovirus Infection, Encephalomyelitis, Endocrine opthalmopathy, Epstein-Barr Virus Infection, Equine Heaves, Erythematosis, Evan's Syndrome, Felty's Syndrome, Fibromyalgia, Fuch's Cyclitis, Gastric Atrophy, Gastrointestinal Allergy, Giant Cell Arteritis, Glomerulonephritis, Goodpasture's Syndrome, Graft v. Host Disease, Graves' Disease, Guillain-Barre Disease, Hashimoto's Myroiditis, Hemolytic Anemia, Henoch-Schonlein Purpura, Idiopathic Adrenal Atrophy, Idiopathic Pulmonary Fibrosis, IgA Nephropathy, Inflammatory Bowel Diseases, Insulin-dependent Diabetes Mellitus, Juvenile Arthritis, Juvenile Diabetes Mellitus (Type 1), Lambert-Eaton Syndrome, Laminitis, Lichen Planus, Lupoid Hepatitis, Lupus, Lymphopenia, Meniere's Disease, Mixed Connective Tissue Disease, Multiple Sclerosis, Myasthenia Gravis, Pernicious Anemia, Polyglandular Syndromes, Presenile Dementia, Primary Agammaglobulinemia, Primary Biiary Cirrhosis, Psoriasis, Psoriatic Arthritis, Raynauds Phenomenon, Recurrent Abortion, Reiter's Syndrome, Rheumatic Fever, Rheumatoid Arthritis, Sampter's Syndrome, Schistosomiasis, Schmidt's Syndrome, Scleroderma, Shulman's Syndrome, Sjorgen's Syndrome, Stiff-Man Syndrome, Sympathetic Ophthalmia, Systemic Lupus Erythematosis, Takayasu's Arteritis, Temporal Arteritis, Thyroiditis, Thrombocytopenia, Thyrotoxicosis, Toxic Epidermal Necrolysis, Type B Insulin Resistance, Type I Diabetes Mellitus, Ulcerative Colitis, Uveitis, Vitiligo, Waldenstrom's Macroglobulemia, Wegener's Granulomatosis.

Multi-Medicant Therapy of Autoimmune Diseases.

Methods for treating an autoimmune disease are also disclosed including administering to a patient in need thereof an effective amount of an Affinity Medicant Linker conjugates or Medicant Linker compound and another therapeutic agent known for the treatment of an autoimmune disease.

Treatment of Infectious Diseases.

The Affinity Medicant Linker conjugates and Medicant Linker compounds are useful for killing or inhibiting the multiplication of a cell that produces an infectious disease or for treating an infectious disease. The Affinity Medicant Linker conjugates and Medicant Linker compounds can be used accordingly in a variety of settings for the treatment of an infectious disease in a patient. The Affinity Medicant Linker conjugates can be used to deliver a Medicant unit to a target cell. In an embodiment of the present invention, AM binds to the infectious disease cell.

In various embodiments of the present invention, the AML or AM conjugates kill or inhibit the multiplication of cells that produce a particular infectious disease including, but not limited to, Diphtheria, Peatussis, Occult Bacteremia, Urinary Tract Infection, Gastroenteritis, Cellulitis, Epiglottitis, Tracheitis, Adenoid Hypertrophy, Retropharyngeal Abcess, Impetigo, Ecthyma, Pneumonia, Endocarditis, Septic Arthritis, Pneumococca, Peritonitis, Bactermia, Meningitis, Acute Purulent Meningitis, Urethritis, Cervicitis, Proctitis, Pharyngitis, Salpingitis, Epididymitis, Gonorrhea, Syphilis, Listeriosis, Anthrax, Nocardiosis, *Salmonella*, Typhoid Fever, Dysentery, Conjunctivitis, Sinusitis, Brucellosis, Tullaremia, Cholera, Bubonic Plague, Tetanus, Necrotizing Enteritis, Actinomycosis, Mixed Anaerobic Infections, Syphilis, Relapsing Fever, Leptospirosis, Lyme Disease, Rat Bite Fever, Tuberculosis, Lymphadenitis, Leprosy, *Chlamydia*, Chlamydial Pneumonia, Trachoma, Inclusion Conjunctivitis Systemic Fungal Diseases: Histoplamosis, Coccidiodomycosis, Blastomycosis, Sporotrichosis, Cryptococcsis, Systemic Candidiasis, Aspergillosis, Mucormycosis, Mycetoma, Chromomycosis Rickettsial Diseases: Typhus, Rocky Mountain Spotted Fever, Ehrlichiosis, Eastern Tick-Borne Rickettsioses, Rickettsialpox. Q Fever, Bartonellosis Parasitic Diseases: Malaria, Babesiosis, African Sleeping Sickness, Chagas' Disease, Leishmaniasis, Dum-Dum Fever, Toxoplasmosis, Meningoencephalitis, Keratitis, Entamebiasis, Giardiasis, Cryptosporidiasis, Isosporiasis, Cyclosporasis, Microsporidiosis, Ascariasis, Whipworm Infection. Hookworm Infection. Threadworm Infection. Ocular Larva Migrans, Trichinosis, Guinea Worm Disease, Lymphatic Filariasis, Loiasis, River Blindness, Canine Heartworm Infection, Schistosomiasis, Swimmer's Itch, Oriental Lung Fluke, Oriental Liver Fluke, Fascioliasis, Fasciolopsiasis, Opisthorchiasis, Tapeworm Infections, Hydatid Disease, Alveolar Hydatid Disease Viral Diseases: Measles, Subacute sclerosing panencephalitis, Common Cold, Mumps, Rubella, Roseola, Fifth Disease, Chickenpox, Respiratory syncytial virus infection. Croup, Bronchiolitis, Infectious Mononucleosis, Poliomyelitis, Herpangina, Hand-Foot-and-Mouth Disease, Bornholm Disease, Genital Herpes, Genital Warts, Aseptic Meningitis, Myocarditis, Pericarditis, Gastroenteritis, Acquired Immunodeficiency Syndrome (AIDS), Human Immunodeficiency Virus (HIV), Reye's Syndrome, Kawasaki Syndrome, Influenza, Bronchitis, Viral "Walking" Pneumonia, Acute Febrile Respiratory Disease, Acute pharyngoconjunctival fever, Epidemic keratoconjunctivitis, Herpes Simplex Virus 1 (HSV-1), Herpes Simplex Virus 2 (HSV-2), Shingles, Cytomegalic Inclusion Disease, Rabies, Progressive Multifocal Leukoencephalopathy, Kuru, Fatal Familial Insomnia, Creutzfeldt-Jakob Disease, Gerstmann-Straussler-Scheinker Disease, Tropical Spastic Paraparesis, Western Equine Encephalitis, California Encephalitis, St. Louis Encephalitis, Yellow Fever, Dengue, Lymphocytic choriomeningitis, Lassa Fever, Hemorrhagic Fever, Hantvirus Pulmonary Syndrome, Maburg Virus Infections, Ebola Virus Infections, Smallpox.

Synthesis of AMCs with SMCC and Sulfo-SMCC Linkers.

In an embodiment of the present invention, an affinity medicant conjugate (AMC) 1000 is formed between an AM 1100 and a medicant 1350 by reacting the medicant 1350 with succinimidyl 4-(N-maleimidomethyl)-cyclohexane-1-carboxylate (SMCC) which forms an active intermediate that reacts with a sulfhydryl groups on the AM 1100. In an embodiment of the present invention, the resulting AMC includes one or more molecules of the medicant 1350 bound to the AM 1100. In an embodiment of the present invention, the resulting AMC is not cleaved in the cytosol, but internalized and the AM 1100 degraded by proteases in the cytosol until the medicant 1350 is released.

In an alternative embodiment of the present invention, an AMC 1000 is formed between an AM 1100 and a medicant 1350 by reacting the medicant 1350 with sulfosuccinimidyloxycarbonyl-α-methyl-α-(2-pyridyldithio)toluene (Sulfo-SMCC) which forms an active intermediate that reacts with a sulfhydryl groups on the AM 1100 to forma more water soluble AMC. In an embodiment of the present invention, the resulting AMC includes one or more molecules of the medicant 1350 bound to the AM 1100. In an embodiment of the present invention, the resulting AMC is not cleaved in the cytosol, but internalized and the AM 1100 degraded by proteases in the cytosol until the medicant 1350 is released.

In an embodiment of the present invention, an AMC 1000 comprises an AM 1100 bound to a medicant 1350 though an optional linker as illustrated in FIG. 1. In an embodiment of the present invention, an antibody 1110 is bound to a linker 1200 which is bound to the medicant 1350. In an unexpected result, an AMC 1000 can retain both the receptor binding activity of the AM 1100 and the intracellular cytoactivity of the medicant 1350 in a single compound. In an embodiment of the present invention, an antibody 1110 is bound to a linker 1200 which is bound to the medicant 1350. In an unexpected result, an antibody medicant conjugate can retain both the receptor binding activity of the antibody 1110 and the intracellular cytoactivity of an acylfulvene in a single compound. Surprisingly, the antibody is capable of binding to a polypeptide receptor on cell populations thereby bringing the acylfulvene in contact with the cell population.

In an embodiment of the present invention, the medicant moiety is an acylfulvene moiety. An acylfulvene moiety includes irofulven derivatives (see structures shown in FIG. 2A, FIG. 2C, FIG. 2F, FIG. 2H, FIG. 2I, FIG. 2L, FIG. 2M, FIG. 2P, FIG. 2S and FIG. 2U) and illudin derivatives (see structures shown in FIG. 23, FIG. 2D, FIG. 2, FIG. 2G, FIG. 2J, FIG. 2K, FIG. 2N, FIG. 2O, FIG. 2Q, FIG. 2R, FIG. 2T, and FIG. 2V).

Amine Derivative. In an embodiment of the present invention, the irofulvene structures shown in FIG. 2A, FIG. 2C, FIG. 2F, FIG. 2H, FIG. 2I, FIG. 2L and FIG. 2M and illudin structures shown in FIG. 2B, FIG. 2D. FIG. 2E, FIG. 2G, FIG. 2J, FIG. 2K, FIG. 2N and FIG. 2O, where $R_1$ denotes independently a carbon or a heteroatom containing nitrogen (N), oxygen (O) or sulphur (S); where $R_6$ denotes including —H, —CN, —CF$_3$, —O, —NH$_2$, —SO$_3$, —COOH—, substituted or unsubstituted alkyl, substituted or unsubstituted heteroalkyl, substituted or unsubstituted cycloalkyl, substituted or unsubstituted hcterocycloalkyl, substituted or unsubstituted aryl, or substituted or unsubstituted heteroaryl in which incorporated heteroatoms can be halogens (F, Cl, Br, I); nitrogen (N) functional groups including primary amines (—NH$_2$), secondary amines (—NH—), tertiary amines (—NR$_A$R$_B$), imine (—C(=N) H—), (—C(=N)R$_A$—), Azo (—N=N—), Cyanate (—C=N), isocyanate (—N=(C=O), amide (—C(=O) NR$_A$R$_B$) or (—C(=O)NR$_A$H) or (—C(=O)NH$_2$); sulfur (S) functional groups including thioethers (—S—), thiones (—C(=S)—, sulfoxides (—S(=O)—, sulfones (—S (=O)$_2$—), sulfoximes (—S(=OX=NR$_A$)— or (—S(=O) (=NH)—, sulthydryls (—SH), thiocyanate (—S—C (=N)—, isothiocyanate (—N=C(=S); oxygen (O) functional groups including hydroxyl (—OH), carbonyl (—C (=O)—), aldehyde (—C(=O)H, carboxylate (COOH), ethers (—O—), esters (—OC(=O)—), carbonate (—O (C=O)O—); and $R_2$, $R_3$, $R_4$, $R_5$ denote either H, CH$_3$, or CH$_2$OH and where $R_6$ is NH$_2$ (an amino group) for an irofulvene derivative shown in FIG. 2A, FIG. 2C, FIG. 2F, FIG. 2H, FIG. 2I, FIG. 2L and FIG. 2M and illudin derivative shown in FIG. 2B, FIG. 2D, FIG. 2E, FIG. 2G, FIG. 2J, FIG. 2K, FIG. 2N and FIG. 2O.

Table IA shows acylfulvene amine analogs which can be attached to a bi-functional linker which can then be attached to a sulfhydryl reacting group of the AM using the reagent. In an embodiment of the present invention, the acylfulvene amino derivative shown in the first column of Table IA is linked to the AM through the free sulfhydryl group of the AM using the reagent identified in the second column of Table IA to form the AMC.

Figure 8A:
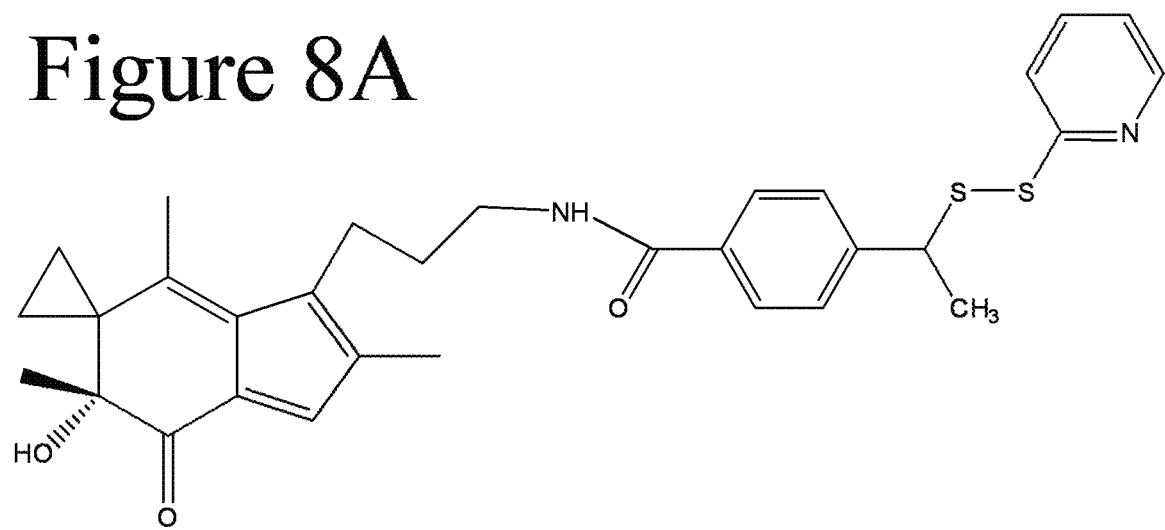
FIG. 8A shows the structure of the analog 211 attached via the amino group using the sulfosuccinimidyl 6-(alpha-methyl-alpha-(2-[pyridyldithio)-toluamido)hexanoste (SMPT) linking reagent according to an embodiment of the invention.
Figure 8B:
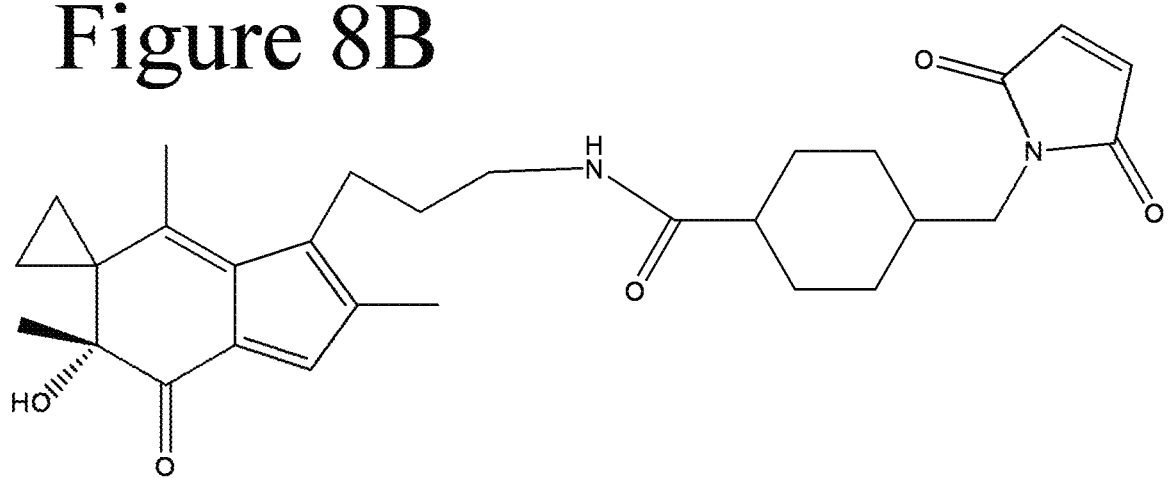
FIG. 8B shows the structure of the analog 211 attached via the amino group using the sulfosuccimidyl 4-(N-maleimido-methyl)cyclohexane-1-carboxylate (SMCC) linking reagent according to an embodiment of the invention.
Figure 8C:
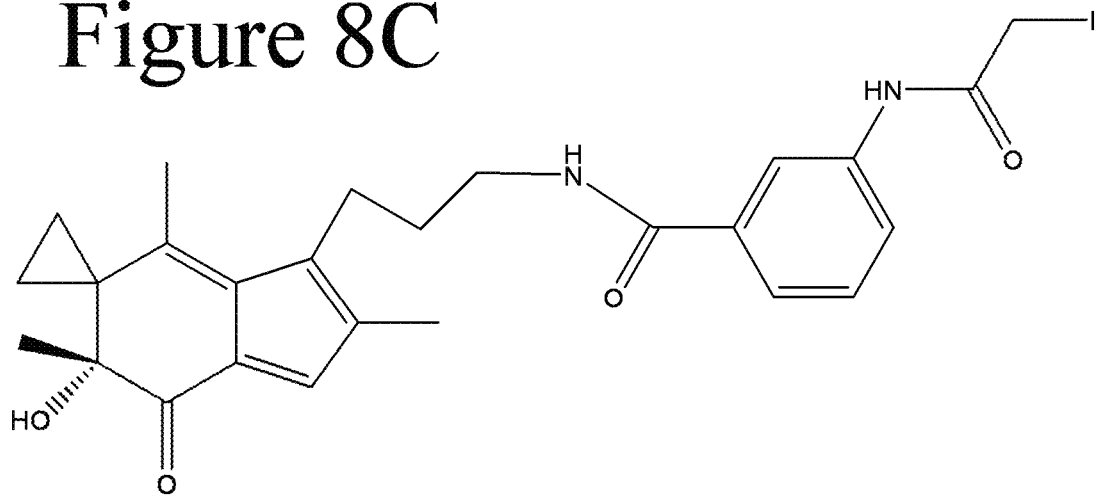
FIG. 8C shows the structure of the analog 211 attached via the amino group using the sulfosuccimidyl(4-iodo-acetyl)aminobenzoate (SIAB) linking reagent according to an embodiment of the invention.

FIG. 8A shows the structure of the analog 211 attached via the amino group using the SMPT linking reagents. FIG. 8B shows the structure of the analog 211 attached via the amino group using the SMCC linking reagent. FIG. 8C shows the structure of the analog 211 attached via the amino group using the SIAB linking reagent.

Table IB shows acylfulvene amine analogs which can be attached to a bi-functional linker which can then be attached to the AM via a photoactivatable group at the other terminus using the reagent. In an embodiment of the present invention, the acylfulvene amino derivative shown in the first column of Table IB is linked to the AM to the AM through the photoactivatable group at the other terminus using the reagent identified in the second column of Table IB to form the AMC.

Table IC shows acylfulvene amine analogs which can be attached to a bi-functional linker which can then be attached to the AM through a reactive amine group at the other terminus using the reagent. In an embodiment of the present invention, the acylfulvene amino derivative shown in the first column of Table IC is linked to the AM through an amine reactive group using the reagent identified in the second column of Table IC to form the AMC.

Table ID shows acylfulvene amine analogs which can be attached to a bi-functional linker which can then be attached to the AM through an aldehyde, carbonyl or carboxylate group at the other terminus using the reagent. In an embodiment of the present invention, the acylfulvene amino derivative shown in the first column of Table ID is linked to the AM through an aldehyde, carbonyl or carboxylate group at the other terminus using the reagent identified in the second column of Table ID to form AMC.

Carboxyl Derivative.

Figure 9A:
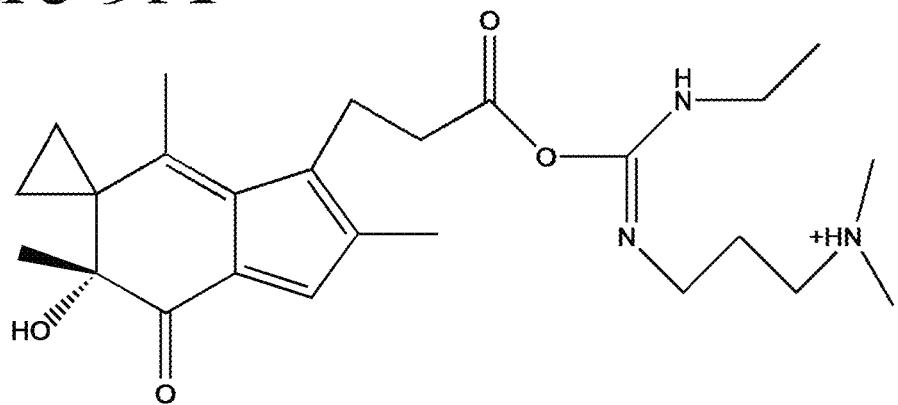
FIG. 9A shows the structure of the analog 038 attached via the carboxyl group using 1-ethyl-3-(3-dimethylaminopropyl) carbodiimide hydrochloride (EDC) linking reagent according to an embodiment of the invention.
Figure 9B:
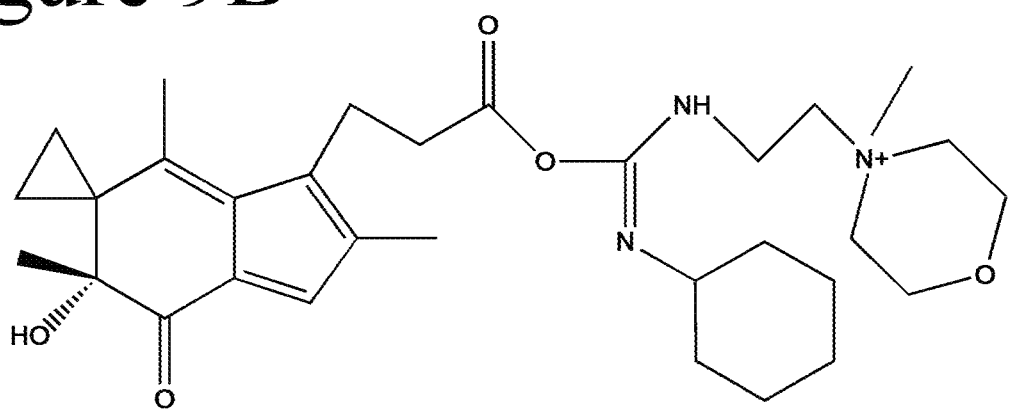
FIG. 9B shows the structure of the analog 038 attached via the carboxyl group using the 1-cyclohexyl-3-2(2-morpholinoethyl)carbodiimide (CMC) linking reagent according to an embodiment of the invention.
Figure 9C:
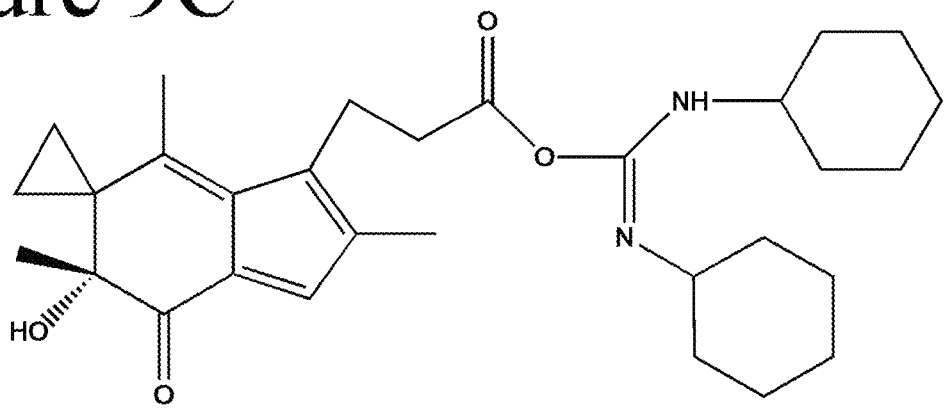
FIG. 9C shows the structure of the analog 038 attached via the carboxyl group using the N,N'-dicyclohexylcarbodiimide (DCC) linking reagent according to an embodiment of the invention.

In an embodiment of the present invention, the irofulvene structures shown in FIG. 2A, FIG. 2C, FIG. 2F, FIG. 2H. FIG. 2I, FIG. 2L and FIG. 2M and illudin structures shown in FIG. 2B, FIG. 2D, FIG. 2E, FIG. 2G, FIG. 2J, FIG. 2K, FIG. 2N and FIG. 2O, where $R_1$ denotes substituted or unsubstituted alkyl, substituted or unsubstituted heteroalkyl, substituted or unsubstituted cycloalkyl, substituted or unsubstituted heterocycloalkyl, substituted or unsubstituted aryl, or substituted or unsubstituted heterooryl in which incorporated heteroatoms can be halogens (F, Cl, Br, I); nitrogen (N) functional groups including primary amines (—$NH_2$), secondary amines (—NH—), tertiary amines (—$NR_AR_B$), imine (—C(=N)H—), (—C(=N)$R_A$—), Azo (—N=N—), Cyanate (—C≡N), isocyanate (—N=(C=O), amide (—C(=O)$NR_AR_B$) or (—C(=O)$NR_AH$) or (—C(=O)$NH_2$); sulfur (S) functional groups including thioethers (—S—), thiones (—C(=S)—, sulfoxides (—S(=O)—, sulfones (—S(=O)$_2$—), sulfoximes (—S(=O)(=$NR_A$)— or (—S(=O)(=NH)—, sulfhydryls (—SH), thiocyanate (—S—C(=N)—, isothiocyanate (—N=C(=S); oxygen (O) functional groups including hydroxyl (—OH), carbonyl (—C(=O)—), aldehyde (—C(=O)H, carboxylate (COOH), ethers (—O—), esters (—OC(—O)—), carbonate (—(C=O)O—); and $R_2$, $R_3$, $R_4$, $R_5$ denote either H, $CH_3$, or $CH_2OH$ and where $R_6$ is $CO_2H$ (a carboxyl group) for an irofulvene derivative shown in FIG. 2A, FIG. 2C, FIG. 2F, FIG. 2H, FIG. 2I, FIG. 2L and FIG. 2M and illudin derivative shown in FIG. 2B, FIG. 2D, FIG. 2E, FIG. 2G, FIG. 2J, FIG. 2K, FIG. 2N and FIG. 2O. $R_5$ is glycine or either an L or D amino acid including alanine, serine, threonine, cysteine, valine, leucine, isoleucine, methionine, proline, phenylalanine, tyrosine, tryptophan, aspartic acid, glutamic acid, asparagine, glutamine, histidine, lysine, arginine, alpha-methyl glycine or 2-dimethylglycine. $R_5$ can also comprise nonstandard amino acids to reduce nonspecific esterase activity present in blood and cells including homocysteine, selenocysteine, pyrrolysine, carnitine, hypusine, lanthionine, 2-aminoisobutyric acid, dehydroalanine, gamma-aminobutyric acid, ornithine, citrulline, α-Amino-n-butyric acid, Norvaline, Norleucine, Pipecolic acid, Alloisoleucine, α,β-diaminopropionic acid, α,γ-diaminobutyric acid, Allothreonine, α-Amino-n-heptanoicacid, Homoserine, n-Amino-n-butyric acid, β-Aminoisobutyric acid, γ-Aminobutyric acid, isovaline, Sarcosine, N-ethyl glycine, N-propyl glycine, N-isopropyl glycine, N-methyl alanine, N-ethyl alanine, N-methyl β-alanine, N-ethyl β-alanine, Isoserine, α-hydroxy-γ-aminobutyric acid, diaminopimelic acid, cystathione, aminoisobutyric acid, dehydroalanine,delta-aminolevulinic acid, 4-aminobenzoic acid, Hydroxyproline, Formylmethioinine, lanthionine, djenkolic acid, Pyroglutamic acid, Hypusine, carboxyglutamic acid, penicillamine, thialysine, quisqualic acid, canavine, azetidine-2-carboxylic acid. FIG. 9A shows the structure of the analog 038 attached via the carboxyl group using the EDC linking reagent. FIG. 9B shows the structure of the analog 038 attached via the carboxyl group using the CMC linking reagent. FIG. 9C shows structure of the analog 038 attached via the carboxyl group using DCC linking reagent.

Table IIA shows acylfulvene carboxylate analogs which can be attached to a bi-functional linker which can then be attached to a sulfhydryl reacting group of the AM. In an embodiment of the present invention, the acylfulvene carboxylate derivative shown in the first column of Table IIA is linked to the AM through the free sulfhydryl group of the AM using the reagent identified in the second column of Table IIA to form the AMC.

Table IIB shows acylfulvene carboxylate analogs which can be attached to a bi-functional linker, where the linker also contains a photoactivatable reactive group which can attach to the AM. In an embodiment of the present invention, the acylfulvene carboxylate derivative shown in the first column of Table IIB is linked to the AM through the photoactivatable reactive group using the reagent identified in the second column of Table IIB to form the AMC.

Table IIC shows acylfulvene carboxylate analogs which can be attached to a bi-functional linker, where the linker also contains an amino reactive group which can attach to the AM. In an embodiment of the present invention, the acylfulvene carboxylate derivative shown in the first column of Table IIC is linked to the AM through the amino group using the reagent identified in the second column of Table IIC to form the AMC.

Azlactone Derivative.

Figure 10A:
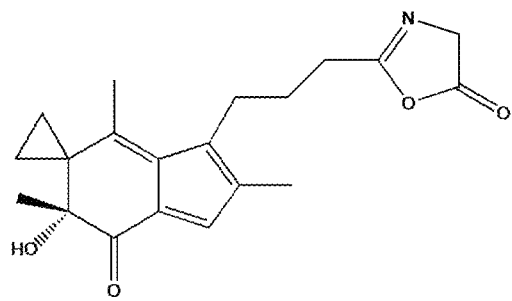
FIG. 10A shows the structure of the analog 038 attached via the carboxyl group using DCC or N,N'-diisopropylcarbodiimide (DIC) linking reagents in the presence of glycine according to various embodiments of the invention.
Figure 10B:
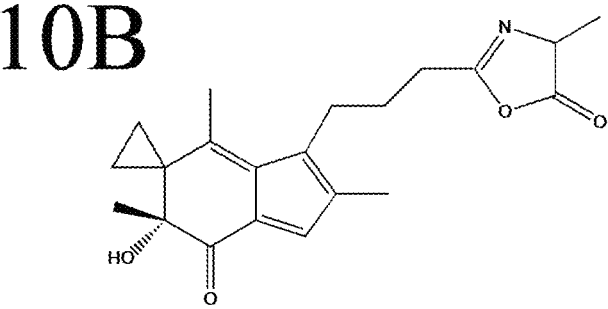
FIG. 10B shows the structure of the analog 038 attached via the carboxyl group using DCC or DIC linking reagents in the presence of alanine according to various embodiments of the invention.
Figure 10C:
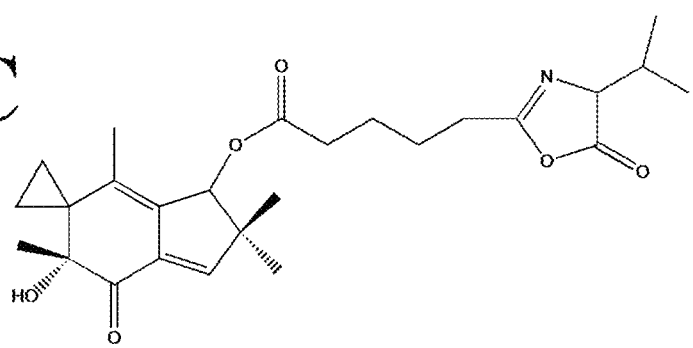
FIG. 10C shows the structure of the analog 106 attached via the carboxyl group using DCC or DIC linking reagents in the presence of valine according to various embodiments of the invention.

FIG. 10A shows the structure of the analog 038 attached via the carboxyl group using DCC or DIC linking reagents in the presence of glycine. FIG. 10B shows the structure of the analog 038 attached via the carboxyl group using DCC or DIC linking reagents in the presence of alanine. FIG. 10C shows the structure of the analog 106 attached via the carboxyl group using DCC or DIC linking reagents in the presence of valine.

Table IID shows acylfulvene carboxylate analogs which can be reacted to form acylfulvene azlactone derivatives where the azlactone reactive group can be used to attach to the AM. In an embodiment of the present invention, the acylfulvene derivative shown in the first column of Table IID is converted to the acylfulvene azlactone derivative (see FIG. 2P) using the reagent identified in the second column of Table IID to form the AMC.

Carbonyl Derivative.

In an embodiment of the present invention, the irofulvene structures shown in FIG. 2A, FIG. 2C, FIG. 2F, FIG. 2H, FIG. 2I, FIG. 2L and FIG. 2M and illudin structures shown in FIG. 2B, FIG. 2D, FIG. 2E, FIG. 2G, FIG. 23, FIG. 2K, FIG. 2N and FIG. 2O, where $R_1$ and $R_7$ denote independently substituted or unsubstituted alkyl, substituted or unsubstituted heteroalkyl, substituted or unsubstituted cycloalkyl, substituted or unsubstituted heterocycloalkyl, substituted or unsubstituted aryl, or substituted or unsubstituted heteroaryl in which incorporated heterostems can be halogens (F, Cl, Br, I); nitrogen (N) functional groups including primary amines (—$NH_2$), secondary amines (—NH—), tertiary amines (—$NR_AR_B$), imine (—C(=N)H—), (—C(=N)$R_A$—), Azo (—N=N—), Cyanate (—C≡N), isocyanate (—N=(C=O), amide (—C(=O)$NR_AR_B$) or (—C(=O)$NR_AH$) or (—C(=O)$NH_2$); sulfur (S) functional groups including thioethers (—S—), thiones (—C(=S)—, sulfoxides (—S(=O)—, sulfones (—S(=O)—), sulfoximes (—S(=O)(=$NR_A$)— or (—S(=O)(=NH)—, sulthydryls (—SH), thiocyanate (—S—C(=N)—, isothiocyanate (—N=C(=S); oxygen (O) functional groups including hydroxyl (—OH), carbonyl (—C(=O)—), aldehyde (—C(=O)H, carboxylate (COOH), ethers (—O—), esters (—OC(=O)—), carbonate (—O(C=O)O—); and $R_2$, $R_3$, $R_4$, $R_5$ denote either H, $CH_3$, or $CH_2OH$ and where $R_6$ is CO—$R_7$ (a carbonyl linking group) for an irofulvene derivative shown in FIG. 2A, FIG. 2C, FIG. 2F, FIG. 2H, FIG. 2I, FIG. 2L and FIG. 2M and illudin derivative shown in FIG. 2, FIG. 2D, FIG. 2E, FIG. 2G, FIG. 2J, FIG. 2K, FIG. 2N and FIG. 2O.

Figure 11A:
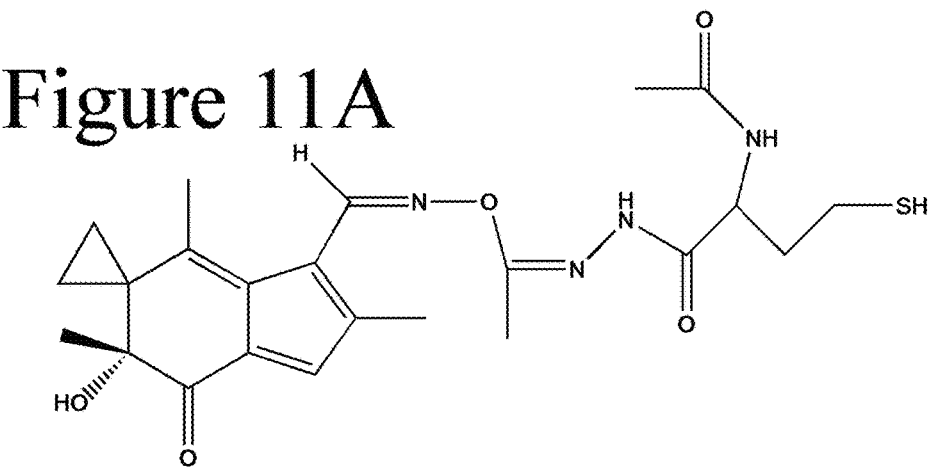
FIG. 11A shows the structure of the analog 124 attached via the carbonyl group using the 2-acetamido-4-mercaptobutyric acid hydrazide (AMBH) linking reagent according to an embodiment of the invention.
Figure 11B:
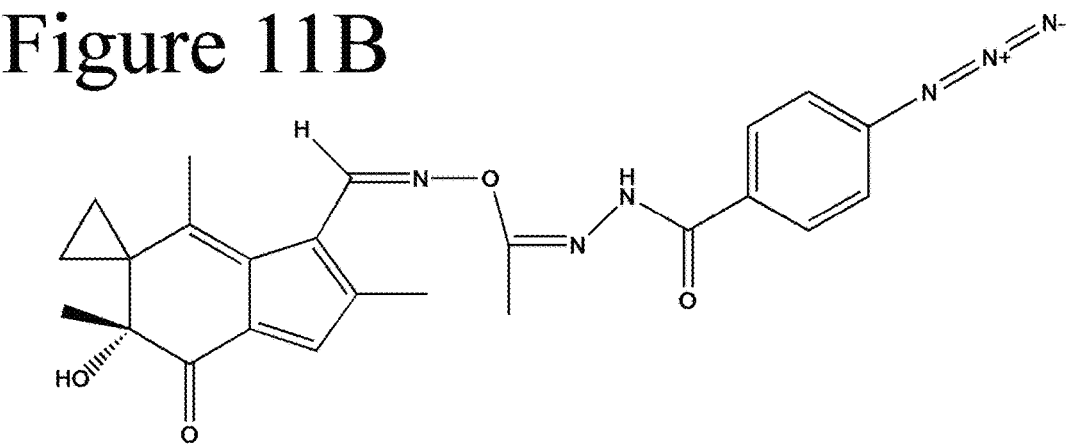
FIG. 11B shows the structure of the analog 124 attached via the carbonyl group using the p-azidobenzoyl hydrazide (ABH) linking reagent according to an embodiment of the invention.
Figure 11C:
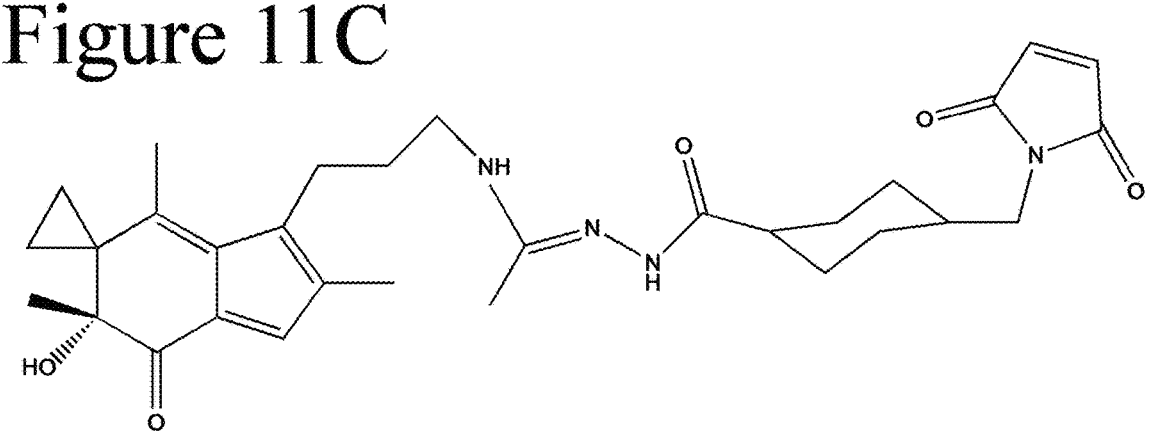
FIG. 11C shows the structure of the analog 201 attached via the 4-(N-maleimidomethyl) cyclohexanee-1-1carboxyl-hydrazide ($M_2C_2H$) linking reagent according to an embodiment of the invention.

FIG. 11A shows the structure of the analog 124 attached via the carbonyl group using the AMBH linking reagent. FIG. 11B shows the structure of the analog 124 attached via the carbonyl group using the ABH linking reagent. FIG. 11C shows the structure of the analog 201 attached via the $M_2C_2H$ linking reagent.

Table IIIA shows acylfulvene carbonyl analogs which can be attached to a bi-functional linker which can be attached to a sulfhydryl reacting group of the AM using the reagent. In an embodiment of the present invention, the acylfulvene carbonyl derivative shown in the first column of Table IIIA is linked to the AM through the free sulfhydryl group of the AM using the reagent identified in the second column of Table IIIA to form the AMC.

Table IIIB shows acylfulvene carbonyl analogs which can be attached to a bi-functional linker, where the linker also contains a photoactivatable reactive group which can attach to the AM using the reagent. In an embodiment of the present invention, the acylfulvene carbonyl derivative shown in the first column of Table IIIB is linked to the AM through the photoactivatable reactive group using the reagent identified in the second column of Table IIIB to form the AMC.

Table IIIC shows acylfulvene carbonyl analogs which can be attached to a bi-functional linker, where the linker also contains an amine reactive group which can attach to the AM using the reagent. In an embodiment of the present invention, the acylfulvene carbonyl derivative shown in the first column of Table IIIC is linked to the AM through the amino group using the reagent identified in the second column of Table IIIC to form the AMC.

Aldehyde Derivative.

In an embodiment of the present invention, the irofulvene structures shown in FIG. 2A, FIG. 2C, FIG. 2F, FIG. 2H, FIG. 2I, FIG. 2L and FIG. 2M and illudin structures shown in FIG. 2B, FIG. 2D, FIG. 2E, FIG. 2G, FIG. 2J, FIG. 2K, FIG. 2N and FIG. 2O, where $R_1$ denotes substituted or unsubstituted alkyl, substituted or unsubstituted heteroalkyl, substituted or unsubstituted cycloalkyl, substituted or unsubstituted heterocycloalkyl, substituted or unsubstituted aryl, or substituted or unsubstituted heteroaryl in which incorporated heteroatoms can be halogens (F, Cl, Br, I); nitrogen (N) functional groups including primary amines (—$NH_2$), secondary amines (—NH—), tertiary amines (—$NR_AR_B$), imine (—C(=N)H—), (—C(=N)$R_A$—), Azo (—N=N—), Cyanate (—C≡N), isocyanate (—N=(C=O), amide (—C(=O)$NR_AR_B$) or (—C(=O)$NR_AH$) or (—C(=O)$NH_2$); sulfur (S) functional groups including thioethers (—S—), thiones (—C(=S)—, sulfoxides (—S(=O)—, sulfones (—S(=O)$_2$—), sulfoximes (—S(=O)(=$NR_A$)— or (—S(=O)(=NH)—, sulthydryls (—SH), thiocyanate (—S—C(=N)—, isothiocyanate (—N=C(=S); oxygen (O) functional groups including hydroxyl (—OH), carbonyl (—C(=O)—), aldehyde (—C(=O)H, carboxylate (COOH), ethers (—O—), esters (—OC(=O)—), carbonate (—O(C=O)O—); and $R_2$, $R_3$, $R_4$, $R_5$ denote either H, $CH_3$, or $CH_2OH$ and where $R_6$ is HCO (an aldehyde group) for an irofulvene derivative shown in FIG. 2A, FIG. 2C, FIG. 2F, FIG. 2H, FIG. 2I, FIG. 2L and FIG. 2M and illudin derivative shown in FIG. 2B, FIG. 2D, FIG. 2E, FIG. 2G, FIG. 2I, FIG. 2K, FIG. 2N and FIG. 2O.

Figure 12A:
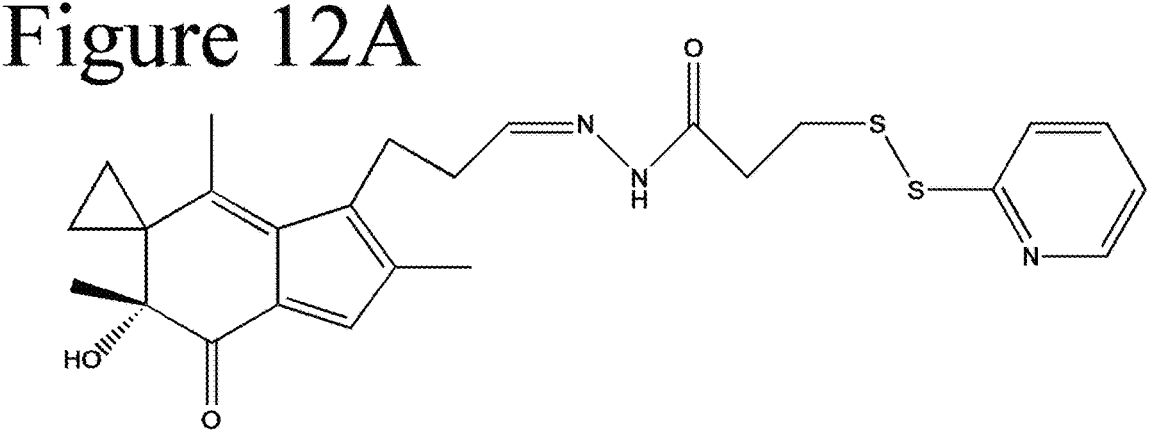
FIG. 12A shows the structure of the analog 010 attached via the aldehyde group using the 3-(2-pyridyldithio) propionyl hydrazide (PDPH) linking reagent according to an embodiment of the invention.
Figure 12B:
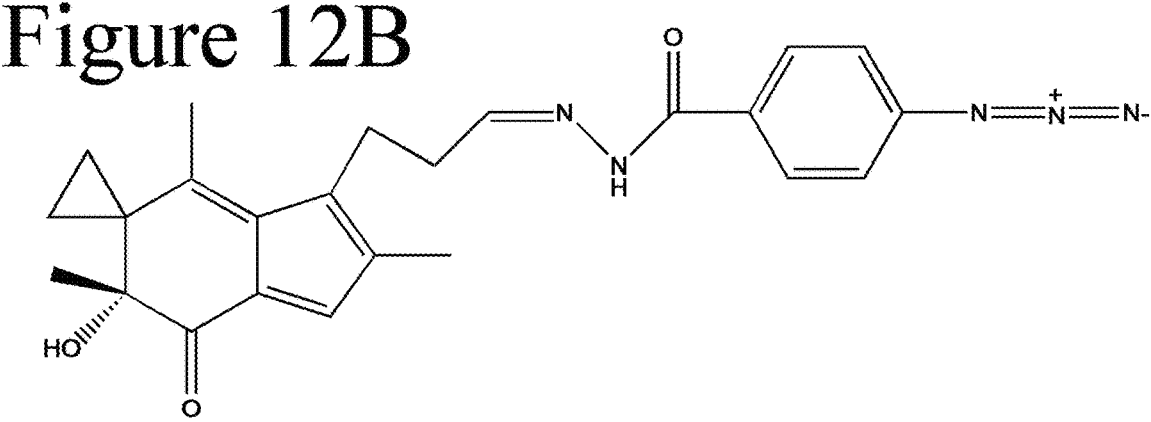
FIG. 12B shows the structure of the analog 010 attached via the aldehyde group using the ABH linking reagent according to an embodiment of the invention.
Figure 12C:
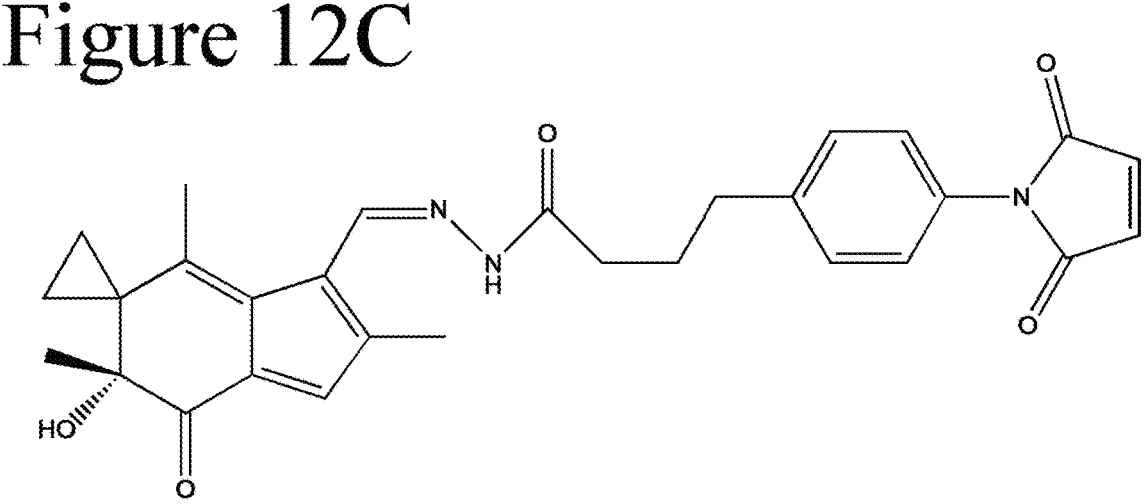
FIG. 12C shows the structure of the analog 011 attached via 4-(4-N-maleimidophenyl)-butyric acid hydrazide (MPBH) linking reagent according to an embodiment of the invention.

FIG. 12A shows the structure of the analog 010 attached via the aldehyde group using the PDPH linking reagent. FIG. 12B shows the structure of the analog 010 attached via the aldehyde group using the ABH linking reagent. FIG. 12C shows the structure of the analog 011 attached via MPBH linking reagent.

Table IVA shows acylfulvene aldehyde analogs which can be attached to a bi-functional linker which can be attached to a sulfhydryl reacting group of the AM using the reagent. In an embodiment of the present invention, the acylfulvene aldehyde derivative shown in the first column of Table IVA is linked to the AM through the free sulthydryl group of the AM using the reagent identified in the second column of Table IVA to form the AMC.

Table IVB shows acylfulvene aldehyde analogs which can be attached to a bi-functional linker, where the linker also contains a photoactivatable reactive group which can attach to the AM using the reagent. In an embodiment of the present invention, the acylfulvene aldehyde derivative shown in the first column of Table IVB is linked to the AM through the photoactivatable reactive group using the reagent identified in the second column of Table IVB to form the AMC.

Table IVC shows acylfulvene aldehyde analogs which can be attached to a bi-functional linker, where the linker also contains an amine reactive group which can attach to the AM using the reagent. In an embodiment of the present invention, the acylfulvene aldehyde derivative shown in the first column of Table IVC is linked to the AM through the amino group using the reagent identified in the second column of Table IVC to form the AMC.

Alcohol Derivative.

Figure 2A:
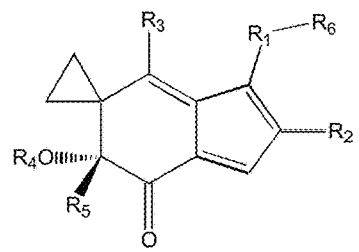
FIG. 2A, FIG. 2C, FIG. 2F, FIG. 2H, FIG. 2I, FIG. 2L and FIG. 2M show the structures of irofulvene medicant moieties, according to various embodiments of the invention.
Figure 2B:
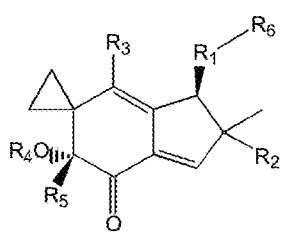
FIG. 2B, FIG. 2D, FIG. 2E, FIG. 2G, FIG. 2J, FIG. 2K, FIG. 2N and FIG. 2O show the structures of illudin medicant moieties, according to various embodiments of the invention.
Figure 2C:
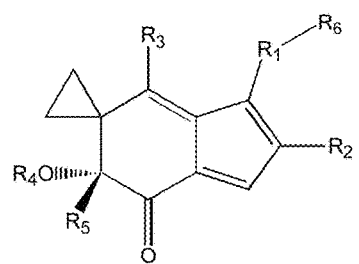
Figure 2D:
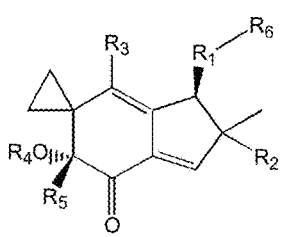
Figure 2E:
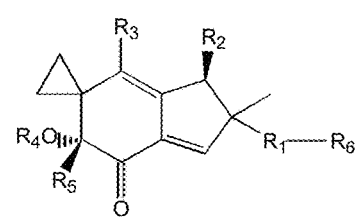
Figure 13A:
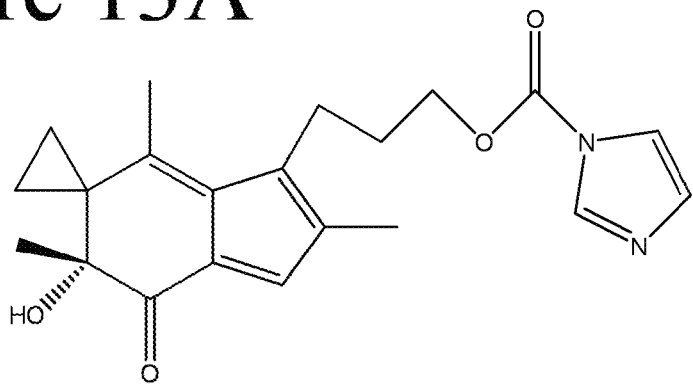
FIG. 13A shows the structure of the analog 009 attached via the alcohol group using the N,N'-carbonyldiimidazole (CDI) linking reagent according to an embodiment of the invention.
Figure 13B:
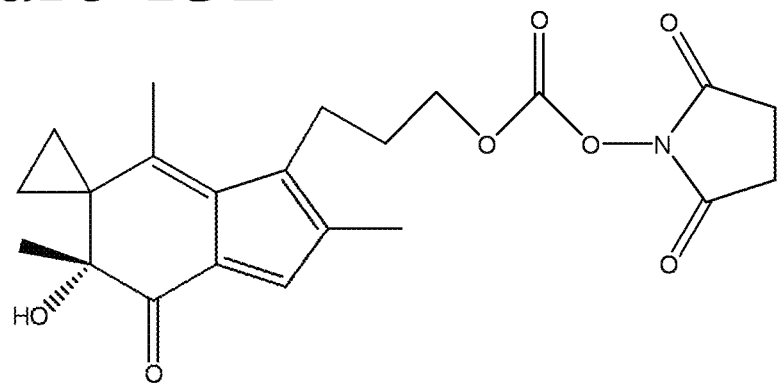
FIG. 13B shows the structure of the analog 009 attached via the alcohol group using the N-hydroxysuccinimidyl chloroformate (HSC) linking reagent according to an embodiment of the invention.
Figure 13C:
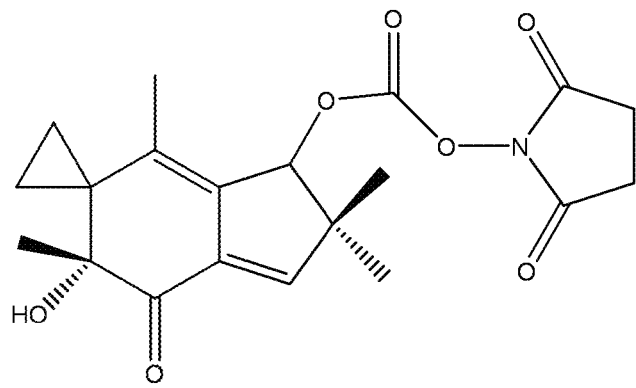
FIG. 13C shows the structure of the medicant moiety Illudin M (FIG. 16A) attached via the N,N'-disuccinimidyl carbonate (DSC) linking reagent according to an embodiment of the invention.

In an embodiment of the present invention, the structures shown in FIG. 2C, FIG. 2D, and FIG. 2E, $R_1$ denotes substituted or unsubstituted alkyl, substituted or unsubstituted heteroalkyl, substituted or unsubstituted cycloalkyl, substituted or unsubstituted heterocycloalkyl, substituted or unsubstituted aryl, or substituted or unsubstituted heteroaryl in which incorporated heteroatoms can be halogens (F, Cl, Br, I); nitrogen (N) functional groups including primary amines (—NH$_2$), secondary amine (—NH—), tertiary amines (—NR$_A$R$_B$), imine (—C(=N)H—), (—C(=N)R$_A$—), Azo (—N=N—), Cyanate (—C≡N), isocyanate (—N=(C=O), amide (—C(=O)NR$_A$R$_B$) or (—C(=O)NR$_A$H) or (—C(=O)NH$_2$); sulfur (S) functional groups including thioethers (—S—), thiones (—C(=S)—, sulfoxides (—S(=O)—, sulfones (—S(=O)$_2$—), sulfoximes (—S(=O)(=NR$_A$)— or (—S(=O)(=NH)—, sulfhydryls (—SH), thiocyanate (—S—C(=N)—, isothiocyanate (—N=C(=S); oxygen (O) functional groups including hydroxyl (—OH), carbonyl (—C(=O)—), aldehyde (—C(=O)H, carboxylate (COOH), ethers (—O—), esters (—OC(=O)—), carbonate (—O(C=O)O—); and R$_2$, R$_3$, R$_4$, R$_5$ denote either H, CH$_3$, or CH$_2$OH for an irofulven derivative (FIG. 2C), an illudin ring derivative (FIG. 2D) or an illudin alkyl derivative (FIG. 2E). FIG. 13A shows the structure of the analog 009 attached via the alcohol group using the CD1 linking reagent. FIG. 13B shows the structure of the analog 009 attached via the alcohol group using the HSC linking reagent. FIG. 13C shows the structure of the medicant moiety illudin M attached via the DSC linking reagent.

Table VA shows acylfulvene alcohol analogs which can be attached to a bi-functional linker which can be attached to a sulfhydryl reacting group of the AM using the reagent. In an embodiment of the present invention, the acylfulvene alcohol derivative shown in the first column of Table VA is linked to the AM through the free sulfhydryl group of the AM using the reagent identified in the second column of Table VA to form the AMC.

Table VB shows acylfulvene alcohol analogs which can be attached to a bi-functional linker, where the linker also contains an amine reactive group which can attach to the AM using the reagent. In an embodiment of the present invention, the acylfulvene alcohol derivative shown in the first column of Table VB is linked to the AM through the amino group using the reagent identified in the second column of Table VB to form the AMC.

Sulfhydryl Derivative.

In an embodiment of the present invention, the structures shown in FIG. 2C, FIG. 2D, and FIG. 2E, R$_1$ and R$_6$ denote independently substituted or unsubstituted alkyl, substituted or unsubstituted heteroalkyl, substituted or unsubstituted cycloalkyl, substituted or unsubstituted heterocycloalkyl, substituted or unsubstituted aryl, or substituted or unsubstituted heteroaryl in which incorporated heteroatoms can be halogens (F, Cl, Br, I); nitrogen (N) functional groups including primary amines (—NH$_2$), secondary amines (—NH—), tertiary amine (—NR$_A$R$_B$), imine (—C(=N)H—), (—C(=N)R$_A$—), Azo (—N=N—), Cyanate (—C≡N), isocyanate (—N=(C=O), amide (—C(=O)NR$_A$R$_B$) or (—C(=O)NR$_A$H) or (—C(=O)NH$_2$); sulfur (S) functional groups including thioethers (—S—), thiones (—C(=S)—, sulfoxides (—S(=O)—, sulfones (—S(=O)$_2$—), sulfoximes (—S(=O)(=NR$_A$)— or (—S(=O)(=NH)—, sulfhydryls (—SH), thiocyanate (—S—C(=N)—, isothiocyanate (—N=C(=S); oxygen (O) functional groups including hydroxyl (—OH), carbonyl (—C(=O)—), aldehyde (—C(=O)H, carboxylate (COOH), ethers (—O—), esters (—OC(=O)—), carbonate (—O(C=O)O—); and R$_2$, R$_3$, R$_4$, R$_5$ denote either H, CH$_3$, or CH$_2$OH, and R$_2$, R$_3$, R$_4$, R$_5$ denote either H, CH$_3$, or CH$_2$OH and R$_7$ is SH or SS—R$_8$ for an irofulven derivative (FIG. 2C), an illudin ring derivative (FIG. 2D) or an illudin alkyl derivative (FIG. 2E). FIG. 14A shows the structure of the analog 051 attached via the sulfhydryl group using SMCC linking reagent. FIG. 14B shows the structure of the analog 051 attached via the sulthydryl group using MPBH linking reagent. FIG. 14C shows structure of the analog 051 attached via sulfhydryl group using PDPH linking reagent.

In an embodiment of the present invention, analog 051 can be attached to an AM by attaching a disulfide bridge at 6' position, a terminal cysteine or n-acetylcysteine group. Analog 051 has a free sulfhydryl group which can react with other sulfhydryl groups to produce a disulfide bond or alternatively react with specific sulfhydryl-reacting groups such as malonic acid derivatives. The other sulfhydryl groups can be on a linker, where the free sulfhydryl group will react with sulfhydryl reactive groups on the linkers, e.g., malonic acid derivatives such as SMCC. Alternatively a medicant with a free sulfhydryl can directly react with free sulfhydryl groups on an AM (such as are present in cysteine residues).

Table VIA shows acylfulvene sulfhydryl analogs which can be attached to a bi-functional linker, where the linker also contains an amine reactive group which can attach to the AM using the reagent (a reducing agent can be used to reduce the disulfide and generate a sulfhydryl group). In an embodiment of the present invention, the acylfulvene sulfhydryl derivative shown in the first column of Table VIA is linked to the AM through the free amino group of the bi-functional linker using the reagent identified in the second column of Table VIA to form the AMC.

Table VIB shows acylfulvene sulfhydryl analogs which can be attached to a bi-functional linker, where the linker also contains a sulfhydryl reacting group which can attach to the AM using the reagent (a reducing agent can be used to reduce the disulfide and generate a sulthydryl group). In an embodiment of the present invention, the acylfulvene sulfhydryl derivative shown in the first column of Table VIB is linked to the AM through the free sulfhydryl group of the bi-functional linker using the reagent identified in the second column of Table VIB to form the AMC.

Table VIC shows acylfulvene sulfhydryl analogs which can be attached to a bi-functional linker, where the linker also contains a photoactivatable reactive group which can attach to the AM using the reagent (a reducing agent can be used to reduce the disulfide and generate a sulthydryl group). In an embodiment of the present invention, the acylfulvene sulfhydryl derivative shown in the first column of Table VIC is linked to the AM through the photoactivatable reactive group of the bi-functional linker using the reagent identified in the second column of Table VIC to form the AMC.

Table VID shows acylfulvene sulfhydryl analogs which can be attached to a bi-functional linker, where the linker also contains a carboxylate reactive group which can attach to the AM using the reagent (a reducing agent can be used to reduce the disulfide and generate a sulthydryl group). In an embodiment of the present invention, the acylfulvene sulfhydryl derivative shown in the first column of Table VID is linked to the AM through the carboxylate reactive group of the bi-functional linker using the reagent identified in the second column of Table VID to form the AMC.

Halide Derivative. In an embodiment of the present invention, the structures shown in FIG. 2C, FIG. 2D, and FIG. 2E, R$_1$ denotes substituted or unsubstituted alkyl, substituted or unsubstituted heteroalkyl, substituted or unsubstituted cycloalkyl, substituted or unsubstituted heterocycloalkyl, substituted or unsubstituted aryl, or substituted or unsubstituted heteroaryl in which incorporated heteroatoms can be halogens (F, Cl, Br, I); nitrogen (N) functional groups including primary amines (—NH$_2$), secondary amines (—NH—), tertiary amines (—NR$_A$R$_B$), imine (—C(=N)H—), (—C(=N)R$_A$—), Azo (—N=N—), Cyanate (—C≡N), isocyanate (—N=(C=O), amide (—C (=O)NR$_A$R$_B$) or (—C(=O)NR$_A$H) or (—C(=O)NH$_2$); sulfur (S) functional groups including thioethers (—S—), thiones (—C(=S)—, sulfoxides (—S(=O)—, sulfones (—S(=O)$_2$—), sulfoximes (—S(=O)(=NR$_A$)— or (—S(=O)(=NH)—, sulfhydryls (—SH), thiocyanate (—S—C(=N)—, isothiocyanate (—N=C(=S); oxygen (O) functional groups including hydroxyl (—OH), carbonyl (—C(=O)—), aldehyde (—C(=O)H, carboxylate (COOH), ethers (—O—), esters (—OC(=O)—), carbonate (—O(C=O)O—); and R$_2$, R$_3$, R$_4$, R$_5$ denote either H, CH$_3$, or CH$_2$OH and X is a halogen for an irofulven derivative (FIG. 2C), an illudin ring derivative (FIG. 2D) or an illudin alkyl derivative (FIG. 2E).

In an embodiment of the present invention, the medicant moieties 4, 5, 20, 53, 237 which contain halide groups can react in one of two ways. They will react directly with free sulfhydryl groups present on antibodies/proteins (e.g., on cysteine residues) or they can react with sulfhydryl groups on linkers (e.g., such as malonic acid derivatives such as SMCC). FIG. 2I shows analog 20 linked to DSP (FIG. 21A), DTME (FIG. 21B) and SMPT (FIG. 21C).

Acyl Azide or Azide Derivative.

Figure 2F:
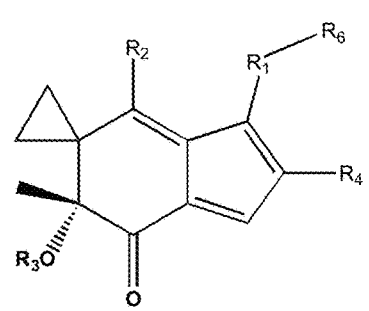
Figure 2G:
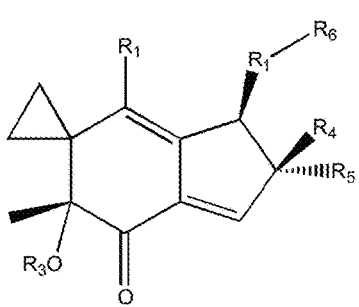
Figure 2H:
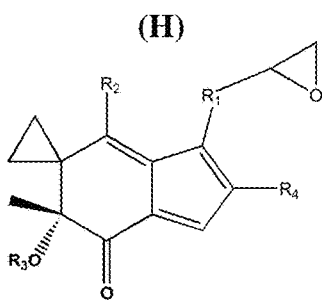
Figure 2I:
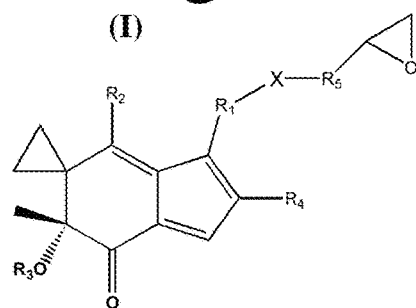

In an embodiment of the present invention, the structures shown in FIG. 2F and FIG. 2G, R$_1$ denotes independently substituted or unsubstituted alkyl, substituted or unsubstituted heteroalkyl, substituted or unsubstituted cycloalkyl, substituted or unsubstituted heterocycloalkyl, substituted or unsubstituted aryl, or substituted or unsubstituted heteroaryl in which incorporated heteroatoms can be halogens (F, Cl, Br, I); nitrogen (N) functional groups including primary amines (—NH$_2$), secondary amines (—NH—), tertiary amines (—NR$_A$R$_B$), imine (—C(=N)H—), (—C(=N)R$_A$—), Azo (—N=N—), Cyanate (—C≡N), isocyanate (—N=C=O), amide (—C(=O)NR$_A$R$_B$) or (—C(=O)NR$_A$H) or (—C(=O)NH$_2$); sulfur (S) functional groups including thioethers (—S—), thiones (—C(=S)—, sulfoxides (—S(=O)—, sulfones (—S(=O)$_2$—), sulfoximes (—S(=O)(=NR$_A$)— or (—S(=O)(=NH)—, sulfhydryls (—SH), thiocyanate (—S—C(=N)—, isothiocyanate (—N=C(=S); oxygen (O) functional groups including hydroxyl (—OH), carbonyl (—C(=O)—), aldehyde (—C(=O)H, carboxylate (COOH), ethers (—O—), esters (—OC(=O)—), carbonate (—(C=O)O—); and R$_2$, R$_3$, R$_4$, R$_5$ denote either H, CH, OH, OCH$_3$, CH$_2$OH, CH$_2$CH$_3$, OCH$_2$CH, for an irofulven derivative (FIG. 2F) or an illudin derivative (FIG. 2G).

In an embodiment of the present invention, the medicant moieties 193, 195, 299, 300, 307 can be photoactivated, with UV radiation. The acyl azides and phenylazides do not need linkers, forming a reactive nitrene group that reacts with primary amines on proteins. The only caveat is the reaction of the drug and protein must be carried out in the absence of thiol reducing agents.

The aide must be on a ring system like a benzene or phenyl group, see analogs 193, 195, 300), 307 and 309.

Epoxide Derivative.

Figure 2J:
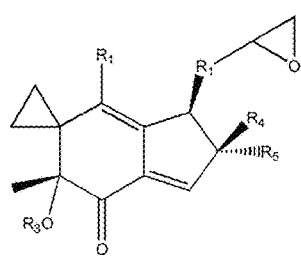
Figure 2K:
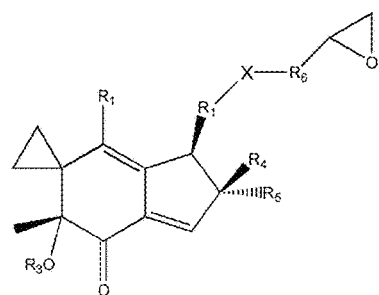
Figure 2L:
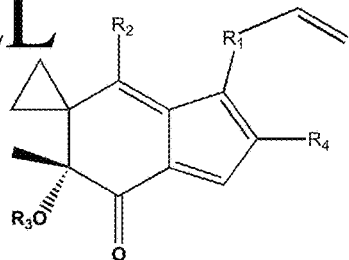
Figure 2M:
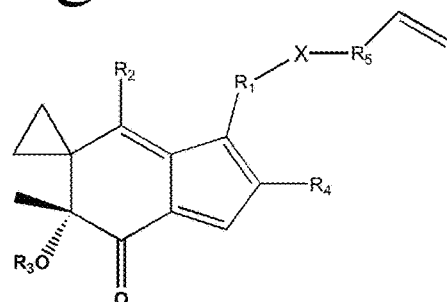

In an embodiment of the present invention, the structures shown in FIG. 2H, FIG. 2I, FIG. 2J and FIG. 2K, where R$_1$ substituted or unsubstituted alkyl, substituted or unsubstituted heteroalkyl, substituted or unsubstituted cycloalkyl, substituted or unsubstituted heterocycloalkyl, substituted or unsubstituted aryl, or substituted or unsubstituted heteroaryl in which incorporated heteroatoms can be halogens (F, Cl, Br, I); nitrogen (N) functional groups including primary amines (—NH$_2$), secondary amines (—NH—), tertiary amines (—NR$_A$R$_B$), imine (—C(=N)H—), (—C(=N)R$_A$—), Azo (—N=N—), Cyanate (—C≡N), isocyanate (—N=C=O), amide (—C(=O)NR$_A$R$_B$) or (—C(=O)NR$_A$H) or (—C(=O)NH$_2$); sulfur (S) functional groups including thioethers (—S—), thiones (—C(=S)—, sulfoxides (—S(=O)—, sulfones (—S(=O)$_2$—), sulfoximes (—S(=O)(=NR$_A$)— or (—S(=O)(=NH)—, sulfhydryls (—SH), thiocyanate (—S—C(=N)—, isothiocyanate (—N=C(=S); oxygen (O) functional groups including hydroxyl (—OH), carbonyl (—C(=O)—), aldehyde (—C(=O)H, carboxylate (COOH), ethers (—O—), esters (—OC(=O)—), carbonate (—O(C=O)O—); and R$_2$, R$_3$, R$_4$, R$_5$ denote either H, CH$_3$, or CH$_2$OH, R$_6$ denotes independently halogen, —CN, —CF$_3$, —OH, —NH$_2$, —SO$_2$, —COOH, substituted or unsubstituted alkyl, substituted or unsubstituted heteroalkyl, substituted or unsubstituted cycloalkyl, substituted or unsubstituted heterocycloalkyl, substituted or unsubstituted aryl, or substituted or unsubstituted heteroaryl; and R$_2$, R$_3$, R$_4$, R$_5$ denote either H, CH$_3$, OH, OCH$_3$, CH$_2$OH, CH$_2$CH$_3$, OCH$_2$CH$_3$ and X denotes a heteroatom including oxygen (O), sulfur (S), and nitrogen (N) for irofulven derivatives (FIG. 2H and FIG. 2I) or illudin derivatives (FIG. 2J and FIG. 2K).

In an embodiment of the present invention, the medicant moieties 114 epoxides react with carboxyl groups, thiols, amines and hydroxyl groups. For example, analog 114 can be linked to ABH, BMPA, or PDPH.

Example 1. Synthesis of Medicant 113

The Wittig reaction was performed on analog 10. First 65 mg CH$_3$PPh$_3$Br (0.185 mmol) in anhydrous THF was cooled to −75° C. and stirred for 1 hour. Then 200 µL of n-butyl lithium (0.183 mmol) was added very slowly to the flask while maintaining temperature at −75° C., and a yellow precipitate formed. It was stirred for another 1.5 hours then analog 10 (50 mg, 0.183 mmol) was slowly added while maintaining temperature at −75° C., followed by stirring for 2.0 hours. The reaction was quenched with ammonium chloride, extracted with CH$_2$Cl$_2$, washed with water, NaHCO$_3$, and saline. Dried over Na$_2$SO$_4$ and concentrated. The residue was eluted through a column (10% ethyl acetate in hexane) to give analog 113 as a solid.

Acroyl Derivative.

Figure 2N:
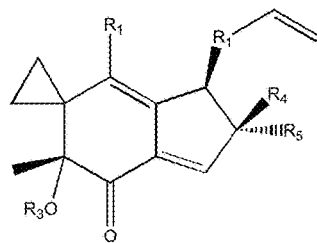
Figure 2O:
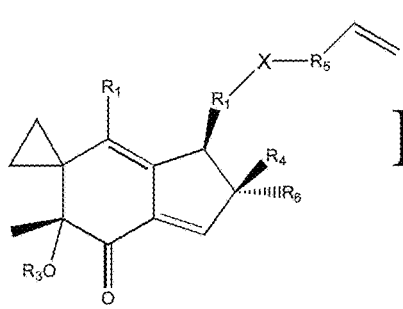
Figure 2S:
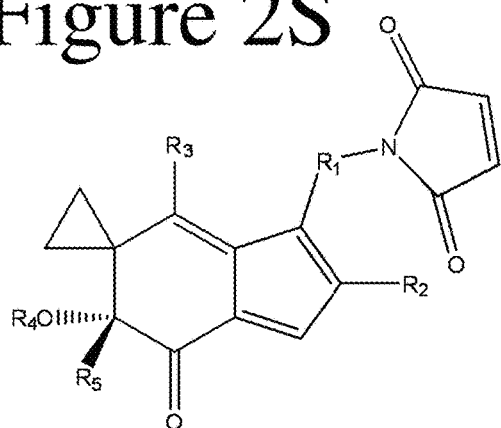
FIG. 2S and FIG. 2T show the structures of the maleimide acylfulvene and maleimide illudin medicant moieties, respectively.
Figure 2T:
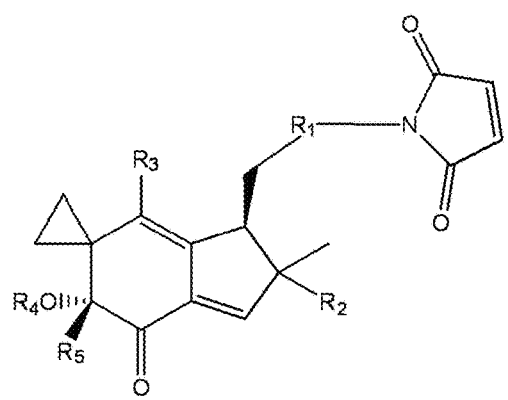
Figure 2U:
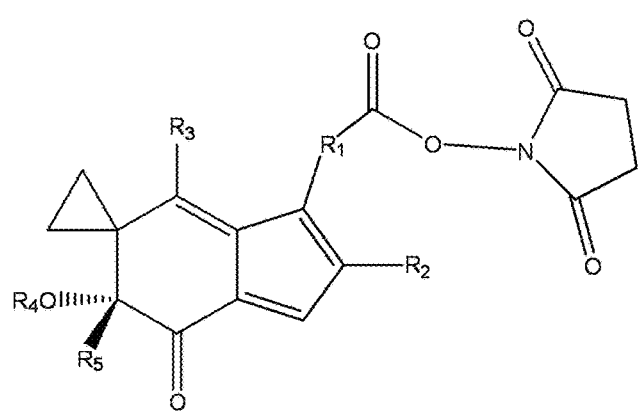
FIG. 2U shows the structure of the maleic acylfulvene medicant moiety, according to an embodiment of the invention.
Figure 2V:
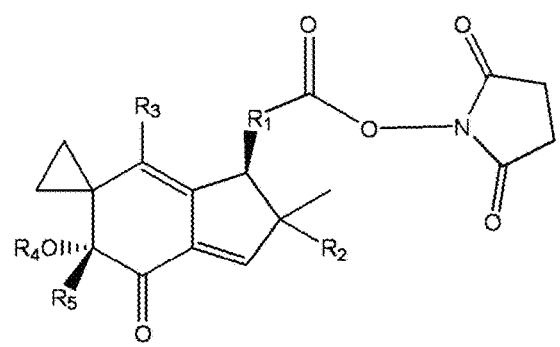
FIG. 2V shows the structure of the maleic illudin medicant moiety, according to an embodiment of the invention.

In an embodiment of the present invention, the structures shown in FIG. 2L, FIG. 2M, and FIG. 2N and FIG. 2O, R$_1$ and R$_6$ denote independently substituted or unsubstituted alkyl, substituted or unsubstituted heteroalkyl, substituted or unsubstituted cycloalkyl, substituted or unsubstituted heterocycloalkyl, substituted or unsubstituted aryl, or substituted or unsubstituted heteroaryl in which incorporated heteroatoms can be halogens (F, Cl, Br, I); nitrogen (N) functional groups including primary amines (—NH$_2$), secondary amines (—NH—), tertiary amines (—NR$_A$R$_B$), imine (—C(=N)H—), (—C(=N)R$_A$—), Azo (—N=N—), Cyanate (—C≡N), isocyanate (—N=C=O), amide (—C(=O)NR$_A$R$_B$) or (—C(=O)NR$_A$H) or (—C(=O)NH$_2$); sulfur (S) functional groups including thioethers (—S—), thiones (—C(=S)—, sulfoxides (—S(=O)—, sulfones (—S(=O)$_2$—), sulfoximes (—S(=O)(=NR$_A$)— or (—S(=O)(=NH)—, sulfhydryls (—SH), thiocyanate (—S—C(=N)—, isothiocyanate (—N=C(=S); oxygen (O) functional groups including hydroxyl (—OH), carbonyl (—C(=O)—), aldehyde (—C(=O)H, carboxylate (COOH), ethers (—O—), esters (—OC(=O)—), carbonate (—O(C=O)O—); and R$_2$, R$_3$, R$_4$, R$_5$ denote independently either H, CH$_2$, OH, OCH$_3$, CH$_2$OH, CH$_2$CH$_3$, OCH$_2$CH and X denotes a heteroatom including oxygen (O), sulfur (S), and nitrogen (N) for irofulven derivatives (FIG. 2L and FIG. 2M) or illudin derivatives (FIG. 2N and FIG. 2O).

In an embodiment of the present invention, the medicant moieties 1300 react predominately with sulfhydryl groups. Acroyl derivatives can react in one of two ways. They will react directly with free sulthydryl groups present on antibodies and proteins (e.g., on cysteine residues) or they will react with sulfhydryl groups on linkers (e.g., such as malonic acid derivatives such as SMCC).

Illudin1 Linked to an Antibody.

Figure 3A:
FIG. 3A shows a schematic descriptions of an AMC 1001 where an Antibody (Ab) 1110 bound to a LU 1200 is bound to a medicant moiety (MM) 1300, according to various embodiments of the invention.
Figure 3B:
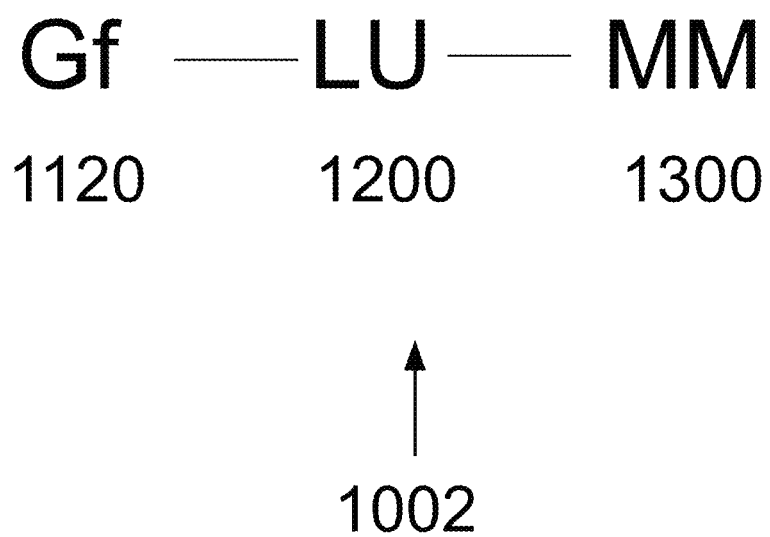
FIG. 3B shows a schematic descriptions of an AMC 1002 where a Growth factor (Of) 1120 bound to a LU 1200 is bound to a medicant moiety (MM) 1300, according to various embodiments of the invention.

In various embodiments of the present invention, an AMC is made up of an antibody 1110 linked to an illudin1 moiety 1301. Various embodiments of the invention, are directed to the methods for the preparation, use, and to pharmaceutical compositions containing an illudin1 moiety 1301 linked to an antibody 1110 to form an antibody medicant conjugate (AMC). In various embodiments the compounds of the present invention, the AMC can have the general formula shown in FIG. 3A, where the antibody 1110 is bound to a linker 1200 which is bound to an illudin1 moiety 1301. In other various embodiments of the present invention, the compounds of the present AMC invention can have the general formula shown in FIG. 3B, where a growth factor 1120 is bound to a linker 1200 which is bound to an illudin1 moiety 1301. In various embodiments the compounds of the present invention include stereoisomers, solvates, and pharmaceutically acceptable salts thereof, where the linker 1200 is as defined in Table X, and the illudin1 1301 is as defined below in Table XI.

Linker to Bind Illudin to an Antibody.

In an embodiment of the present invention, an antibody 1110 with a traditional linker 1240 to an illudin1 moiety 1301 binds to a receptor to which the antibody 1110 was prepared and directs the illudin1 moiety 1301 to cell populations expressing the receptor. In an embodiment of the present invention, an antibody 1110 bound with a traditional linker 1240 to an illudin1 moiety 1301 acts as an AM for a receptor and directs the illudin1 moiety 1301 to tissues containing cells expressing the receptor. In an embodiment of the present invention, an antibody 1110 with a traditional linker 1240 bound to an illudin1 moiety 1301 acts as an AM for a receptor and directs the illudin1 moiety 1301 to tumors containing cells expressing the receptor. In an embodiment of the present invention, an antibody 1110 with a traditional linker 1240 bound to an illudin1 moiety 1301 acts as an AM for a receptor and directs the illudin1 moiety 1301 to tumors containing cells over-expressing the receptor compared to non tumor cells.

Linker to Bind Illudin to Growth Factor.

In an embodiment of the present invention, an illudin1 moiety 1301 linked via a traditional linker 1240 to a growth factor 1120 binds to the growth factor receptor and direct the illudin1 moiety 1301 to cell populations expressing the receptor. In an embodiment of the present invention, a growth factor 1120 linked via a traditional linker 1240 to an illudin1 moiety 1301 acts as an AM for the growth factor receptor and directs the illudin1 moiety 1301 to tissues containing cells expressing the receptor. In an embodiment of the present invention, a growth factor 1120 linked via a traditional linker 1240 to an illudin1 moiety 1301 acts as an AM for the growth factor receptor and directs the iludin1 moiety 1301 to tumors containing cells expressing the receptor. In an embodiment of the present invention, a growth factor 1120 linked via a traditional linker 1240 to an illudin1 moiety 1301 acts as an AM for the growth factor receptor and directs the illudin1 moiety 1301 to tumors containing cells over-expressing the receptor compared to non tumor cells.

Linker to Bind Illudin to Steroid.

Whereby Illudin S, Illudin M, or one of analogs 001 through 316 can be attached, either directly or with a linker, to a steroid which allows preferential binding to a cell overexpressing that particular receptor for that steroid and subsequent killing of the cell (see e.g., Table VII).

Example 2. Synthesis of Medicant-Estrone 107

Analog 106 (see Example 13) (139 mg 0.384 mmol, 1 equiv.), DMAP (4 mg, 0.03 mmol, 0.08 equiv.) and estrone (104.4 mg, 0.384 mmol, 1 equiv.) were dissolved in $CH_2Cl_2$ (14 mL) at 0° C. To this solution was added $CH_2Cl_2$ solution of DCC (460 µL, 1 M, 0.46 mmol, 1.2 equiv.) through a syringe. After 0.5 hours the solution was raised to room temperature. After 2 hours the mixture was filtered and the filtrate was washed with dilute HCl (1.5%), saturated $NaHCO_3$ and brine in sequence. The organic phase was then dried and evaporated. The residue was eluted through a column ($CH_2CH_2Cl_2$/Methanol, 10:0.25) to give analog 107 (100 mg. 42%) as semisolid. Analog 107 can be subsequently linked to estrone.

Example 3. Preparation of Medicant-Estradiol 108

Analog 038 (58.5 mg. 0.2035 mmol), beta-estradiol (58.0 mg. 0.2150 mmol) and DMAP (5 mg. 0.048 mmol) were dissolved in $CH_2Cl_2$ (5.6 mL) at 0° C. To this solution was added $CH_2Cl_2$ solution of DCC (250 µL, 1 M, 0.244 mmol), stirred for 30 minutes, allowed to warm to room temperature then stirred for 1.5 hours. The filtrate was washed with dilute HCl (1.5%), saturated $NaHCO_3$ and brine in sequence. The organic phase was dried over $Na_2SO_4$, and evaporated. The residue was diluted through a column (100% $CH_2Cl_2$), fractions collected then diluted through a second column ($CH_2Cl_2$ plus 0.5% methanol), to give analog 108 (45 mg) as a solid.

Table VII shows the cytotoxic data $IC_{50}$ values (micromolar, 2 hour exposure, N=3, mean±SD) for 108. MCF7 over express estrogen alpha-receptors. MCF9 cells are preferentially killed by 110 the acylfulvene-estrone analog and to a lesser extent 108 the acylfulvene-estradiol analog because estrone preferentially binds to alpha-receptor.

Example 4. Preparation of Medicant-Estradiol 109

Analog 106 (54.5 mg, 0.15 mmol, 1 equiv.), β-estradiol (40.5 mg. 0.15 mmol), and DMAP (1.8 mg, 0.015 mmol, 0.1 equiv.) were dissolved in $CH_2Cl_2$ (5 mL) at 0° C. To this solution was added $CH_2Cl_2$ solution of DCC (165 µL, 1 M, 0.165 mmol, 1.1 equiv.). The mixture was raised to room temperature after 0.5 h. After another 2 h, the mixture was filtered. The filtrate was washed with dilute HCl (1.5%), saturated $NaHCO_3$ and brine in sequence. The organic phase was dried and evaporated. The residue was eluted through a column ($CH_2Cl_2$/Methanol 10:0.25) to give analog 109 (55 mg, 60%) as semisolid.

Example 5. Preparation of Medicant-Estrone 110

Analog 038 (68 mg, 0.2365 mmol), estrone (68.0 mg, 0.2160 mmol) and DMAP (5 mg. 0.048 mmol) were dissolved in $CH_2Cl_2$ (8.0 mL) at 0° C. To this solution was added $CH_2Cl_2$ solution of DCC (300 µL, 1 M, 0.283 mmol), stirred for 30 minutes, allowed to warm to room temperature then stirred for 0.5 hours. The filtrate was washed with dilute HCl (1.5%), saturated NaHCO$_3$ and brine in sequence. The organic phase was dried over Na$_2$SO$_4$, md evaporated. The residue was diluted through a column (100% CH$_2$Cl$_2$), fractions collected then eluted through a second column (CH$_2$Cl$_2$ plus 0.5% methanol), to give analog 110 (40 mg) as a solid.

Table VII shows the cytotoxic data IC$_{50}$ values (micromolar, 2 hour exposure, N=3, mean±SD) for 110. MCF7 cells over express estrogen alpha-receptors. MCF7 cells are preferentially killed by the acylfulvene-estrone analog 110 and to a lesser extent by the acylfulvene-estradiol analog 108 because estrone preferentially binds to alpha-receptor. In contrast, illudin M killed both ER negative and ER positive cells to the same extent. The data in Table VU demonstrates that compounds 108 and 110 are preferentially cytotoxic to cells expressing large numbers of estrogen receptors on their surface.

Example 6. Preparation of Medicant-Testosterone 111

Analog 038 (52.5 mg, 0.182 mmol), testosterone (50.0 mg, 0.173 mmol) and DMAP (5 mg. 0.048 mmol) were dissolved in CH$_2$Cl$_2$ (8.0 mL) at 0° C. To this solution was added CH$_2$Cl$_2$ solution of DCC (250 µL, 1 M), stirred for 30 minutes, allowed to warm to room temperature then stirred for 2 hours. The filtrate was washed with dilute HCl (1.5%), saturated NaHCO$_3$ and brine in sequence. The organic phase was dried over Na$_2$SO$_4$, and evaporated. The residue was eluted through a column (100% CH$_2$Cl$_2$ plus 0.5% methanol), to give analog 111 (15 mg) as a solid.

Example 7. Preparation of Medicant-Androsterone 112

Analog 038 (29 ng), androsterone (25.0 mg) and DMAP (5 mg, 0.048 mmol) were dissolved in CH$_2$Cl$_2$ (5.0 mL) at 0° C. To this solution was added CH$_2$Cl$_2$ solution of DCC (150 µL, 1 M), stirred for 30 minutes, allowed to warm to room temperature then stirred for 2 hours. The filtrate was washed with dilute HCl (1.5%), saturated NaHCO$_3$ and brine in sequence. The organic phase was dried over Na$_2$SO$_4$, and evaporated. The residue was eluted through a column (2:3 ethyl acetate:hexane) to give analog 112 (15 mg) as a solid.

In an embodiment of the present invention, an illudin2 moiety 1302 linked via a traditional linker 1240 to a steroid 1140 bind to receptors for the steroid and directs the illudin2 moiety 1302 to cell populations expressing the receptor. In an embodiment of the present invention, a steroid 1140 linked via a traditional linker 1240 to an illudin2 moiety 1302 acts as an AM for the steroid hormone receptor and directs the illudin2 moiety 1302 to tissues containing cells expressing the receptor. In an embodiment of the present invention, a steroid 1140 linked via a traditional linker 1240 to an illudin2 moiety 1302 acts as an AM for the steroid hormone receptor and directs the illudin2 moiety 1302 to tumors containing cells over-expressing the receptor compared to non tumor cells.

Example 4. Preparation of Medicant-Estradiol 109

Analog 106 (54.5 mg, 0.15 mmol, 1 equiv.), β-estradiol (40.5 mg, 0.15 mmol), and DMAP (1.8 mg, 0.015 mmol, 0.1 equiv.) were dissolved in CH$_2$Cl$_2$ (5 mL) at 0° C. To this solution was added CH$_2$Cl$_2$ solution of DCC (165 µL, 1 M, 0.165 mmol, 1.1 equiv.). The mixture was raised to room temperature after 0.5 h. After another 2 h, the mixture was filtered. The filtrate was washed with dilute HCl (1.5%), saturated NaHCO$_3$ and brine in sequence. The organic phase was dried and evaporated. The residue was eluted through a column (CH$_2$Cl$_2$/Methanol 10:0.25) to give analog 109 (55 mg, 60%) as semisolid.

Example 5. Preparation of Medicant-Estrone 110

Analog 038 (68 mg, 0.2365 mmol), estrone (68.0 mg, 0.2160 mmol) and DMAP (5 mg. 0.048 mmol) were dissolved in CH$_2$Cl$_2$ (8.0 mL) at 0° C. To this solution was added CH$_2$Cl$_2$ solution of DCC (300 µL, 1 M, 0.283 mmol), stirred for 30 minutes, allowed to warm to room temperature then stirred for 0.5 hours. The filtrate was washed with dilute HCl (1.5%), saturated NaHCO$_3$ and brine in sequence. The organic phase was dried over Na$_2$SO$_4$, and evaporated. The residue was eluted through a column (100% CH$_2$Cl$_2$), fractions collected then eluted through a second column (CH$_2$Cl$_2$ plus 0.5% methanol), to give analog 110 (40 mg) as a solid.

Table VII shows the cytotoxic data IC$_{50}$ values (micromolar, 2 hour exposure, N=3, mean±SD) for 110. MCF7 cells over express estrogen alpha-receptors. MCF7 cells are preferentially killed by the acylfulvene-estrone analog 110 and to a lesser extent by the acylfulvene-estradiol analog 108 because estrone preferentially binds to alpha-receptor. In contrast, illudin M killed both ER negative and ER positive cells to the same extent. The data in Table VI demonstrates that compounds 106 and 110 are preferentially cytotoxic to cells expressing large numbers of estrogen receptors on their surface.

Example 6. Preparation of Medicant-Testosterone 111

Analog 038 (52.5 mg, 0.182 mmol), testosterone (50.0 mg, 0.173 mmol) and DMAP (5 mg. 0.048 mmol) were dissolved in CH$_2$Cl$_2$ (8.0 mL) at 0° C. To this solution was added CH$_2$Cl$_2$ a solution of DCC (250 µL, 1 M), stirred for 30 minutes, allowed to warm to room temperature then stirred for 2 hours. The filtrate was washed with dilute HCl (1.5%), saturated NaHCO$_3$ and brine in sequence. The organic phase was dried over Na$_2$SO$_4$, and evaporated. The residue was eluted through a column (100% CH$_2$Cl$_2$ plus 0.5% methanol), to give analog 111 (15 mg) as a solid.

Example 7. Preparation of Medicant-Androsterone 112

Analog 038 (29 mg), androsterone (25.0 mg) and DMAP (5 mg. 0.048 mmol) were dissolved in CH$_2$Cl$_2$ (5.0 mL) at 0° C. To this solution was added CH$_2$Cl$_2$ solution of DCC (150 µL, 1 M), stirred for 30 minutes, allowed to warm to room temperate then stirred for 2 hours. The filtrate was washed with dilute HCl (1.5%), saturated NaHCO$_3$ and brine in sequence. The organic phase was dried over Na$_2$SO$_4$, and evaporated. The residue was eluted through a column (2:3 ethyl acetate:hexane) to give analog 112 (15 mg) as a solid.

In an embodiment of the present invention, an illudin2 moiety 1302 linked via a traditional linker 1240 to a steroid 1140 bind to receptors for the steroid and directs the illudin2 moiety 1302 to cell populations expressing the receptor. In an embodiment of the present invention, a steroid 1140 linked via a traditional linker 1240 to an illudin2 moiety 1302 acts as an AM for the steroid hormone receptor and directs the illudin2 moiety 1302 to tissues containing cells expressing the receptor. In an embodiment of the present invention, a steroid 1140 linked via a traditional linker 1240 to an illudin2 moiety 1302 acts as an AM for the steroid hormone receptor and directs the illudin2 moiety 1302 to tumors containing cells over-expressing the receptor compared to non tumor cells factor receptor and directs the illudin2 moiety 1302 to tissues containing cells expressing the receptor. In an embodiment of the present invention, a growth factor 1120 linked via a FSB linker 1220 to an illudin2 moiety 1302 acts as an AM for the growth factor receptor and directs the illudin2 moiety 1302 to tumors containing cells expressing the receptor. In an embodiment of the present invention, a growth factor 1120 linked via a FSB linker 1220 to an illudin2 moiety 1302 acts as an AM for the growth factor receptor and directs the illudin2 moiety 1302 to tumors containing cells over-expressing the receptor compared to non tumor cells.

FSB Linker to Bind Illudin to a Steroid.

In an embodiment of the present invention, an illudin2 moiety 1302 linked via a FSB linker 1220 to a steroid 1140 binds to receptors for the steroid and direct the illudin2 moiety 1302 to cell populations expressing the receptor. In an embodiment of the present invention, a steroid 1140 linked via a FSB linker 1220 to an illudin2 moiety 1302 acts as a ligand for the steroid hormone receptor and directs the illudin2 moiety 1302 to tissues containing cells expressing the receptor. In an embodiment of the present invention, a steroid 1140 linked via a FSB linker 1220 to an illudin2 moiety 1302 acts as a ligand for the steroid hormone receptor and directs the illudin2 moiety 1302 to tumors containing cells expressing the receptor. In an embodiment of the present invention, a steroid 1140 linked via a FSB linker 1220 to an illudin2 moiety 1302 acts as an AM for the steroid hormone receptor and directs the illudin2 moiety 1302 to tissues containing cells expressing the receptor. In an embodiment of the present invention, a steroid 1140 linked via a FSB linker 1220 to an illudin2 moiety 1302 acts as an AM for the steroid hormone receptor and directs the illudin2 moiety 1302 to tumors containing cells expressing the receptor. In an embodiment of the present invention, a steroid 1140 linked via a FSB linker 1220 to an illudin2 moiety 1302 acts as an AM for the steroid hormone receptor and directs the illudin2 moiety 1302 to tumors containing cells over-expressing the receptor compared to non tumor cells.

FSB Linker to Bind Illudin to an Anti-Anxiogenic Peptide.

In an embodiment of the present invention, an illudin2 moiety 1302 linked via a FSB linker 1220 to an anti-angiogenic peptide 1130 binds to receptors for the anti-angiogenic peptide and directs the illudin2 moiety 1302 to cell populations expressing the receptor. In an embodiment of the present invention, an anti-angiogenic peptide 1130 linked via a FSB linker 1220 to an illudin2 moiety 1302 acts as a ligand for the anti-angiogenic peptide receptor and directs the illudin2 moiety 1302 to tissues containing cells expressing the receptor. In an embodiment of the present invention, an anti-angiogenic peptide 1130 linked via a FSB linker 1220 to an illudin2 moiety 1302 acts as a ligand for the peptide receptor and directs the illudin2 moiety 1302 to tumors containing cells expressing the receptor. In an embodiment of the present invention, an anti-angiogenic peptide 1130 linked via a FSB linker 1220 to an illudin2 moiety 1302 acts as an AM for the anti-angiogenic peptide receptor and directs the illudin2 moiety 1302 to tissues containing cells expressing the receptor. In an embodiment of the present invention, an anti-angiogenic peptide 1130 linked via a FSB linker 1220 to an illudin2 moiety 1302 acts as an AM for the peptide receptor and directs the illudin2 moiety 1302 to tumors containing cells expressing the receptor. In an embodiment of the present invention, an anti-angiogenic peptide 1130 linked via a FSB linker 1220 to an illudin2 moiety 1302 acts as an AM for the peptide receptor and directs the illudin2 moiety 1302 to tumors containing cells over-expressing the receptor compared to non tumor cells.

FSB Linker to Bind Illudin to an Integrin Binding Peptide.

In an embodiment of the present invention, an illudin2 moiety 1302 linked via a FSB linker 1220 to an integrin binding peptide 1150 binds to receptors for the integrin binding peptide and directs the illudin2 moiety 1302 to cell populations expressing the receptor. In an embodiment of the present invention, an integrin binding peptide 1150 linked via a FSB linker 1220 to an illudin2 moiety 1302 acts as a ligand for the integrin binding peptide receptor and directs the illudin2 moiety 1302 to tissues containing cells expressing the receptor. In an embodiment of the present invention, an integrin binding peptide 1150 linked FSB linker 1220 to an illudin2 moiety 1302 acts as a ligand for the integrin binding peptide receptor and directs the illudin2 moiety 1302 to tumors containing cells expressing the receptor. In an embodiment of the present invention, an integrin binding peptide 1150 linked via a FSB linker 1220 to an illudin2 moiety 1302 acts as an AM for the integrin binding peptide receptor and directs the illudin2 moiety 1302 to tissues containing cells expressing the receptor. In an embodiment of the present invention, an integrin binding peptide 1150 linked FSB linker 1220 to an illudin2 moiety 1302 acts as an AM for the integrin binding peptide receptor and directs the illudin2 moiety 1302 to tumors containing cells expressing the receptor. In an embodiment of the present invention, an integrin binding peptide 1150 linked FSB linker 1220 to an illudin2 moiety 1302 acts as an AM for the integrin binding peptide receptor and directs the illudin2 moiety 1302 to tumors containing cells over-expressing the receptor compared to non tumor cells.

FSB Linker to Bind Illudin to a Pro-Peptide.

In an embodiment of the present invention, an illudin2 moiety 1302 linked via a FSB linker 1220 to a pro-peptide 1160 is cleaved by an enzyme 1165 to generate the peptide 1161 and thereafter binds to receptors for the peptide and directs the illudin2 moiety 1302 to cell populations expressing the receptor. In an embodiment of the present invention, a pro-peptide 1160 linked via a FSB linker 1220 to an illudin2 moiety 1302 is cleaved by an enzyme 1165 and thereafter the peptide 1161 acts as a ligand for the peptide receptor and directs the illudin2 moiety 1302 to tissues containing cells expressing the receptor. In an embodiment of the present invention, a pro-peptide 1160 linked via a FSB linker 1220 to an illudin2 moiety 1302 is cleaved by an enzyme 1165 and thereafter the peptide 1161 directs the illudin2 moiety 1302 to tumors containing cells expressing the receptor. In an embodiment of the present invention, a pro-peptide 1160 linked via a FSB linker 1220 to an illudin2 moiety 1302 is cleaved by an enzyme 1165 and thereafter the peptide 1161 acts as an AM for the peptide receptor and directs the illudin2 moiety 1302 to tissues containing cells expressing the receptor. In an embodiment of the present invention, a pro-peptide 1160 linked via a FSB linker 1220 to an illudin2 moiety 1302 is cleaved by an enzyme 1165 and thereafter the peptide 1161 directs the illudin2 moiety 1302 to tumors containing cells expressing the receptor. In an embodiment of the present invention, a pro-peptide 1160 linked via a FSB linker 1220 to an illudin2 moiety 1302 is cleaved by an enzyme 1165 and thereafter the peptide 1161 directs the illudin2 moiety 1302 to tumors containing cells over-expressing the receptor compared to non tumor cells.

FSB Linker to Bind Illudin to a Glycopeptide.

In an embodiment of the present invention, an illudin2 moiety 1302 linked via a FSB linker 1220 to a glycopeptide 1170 with biological activity binds to receptors for the glycopeptide 1170 and directs the illudin2 moiety 1302 to cell populations expressing the receptor. In an embodiment of the present invention, a glycopeptide 1170 linked via a FSB linker 1220 to an illudin2 moiety 1302 acts as a ligand for the glycopeptide receptor and directs the illudin2 moiety 1302 to tissues containing cells expressing the receptor. In an embodiment of the present invention, a glycopeptide 1170 linked via a FSB linker 1220 to an illudin2 moiety 1302 acts as a ligand for the glycopeptide receptor and directs the illudin2 moiety 1302 to tumors containing cells expressing the receptor. In an embodiment of the present invention, a glycopeptide 1170 linked via a FSB linker 1220 to an illudin2 moiety 1302 acts as an AM for the glycopeptide receptor and directs the illudin2 moiety 1302 to tissues containing cells expressing the receptor. In an embodiment of the present invention, a glycopeptide 1170 linked via a FSB linker 1220 to an illudin2 moiety 1302 acts as an AM for the glycopeptide receptor and directs the illudin2 moiety 1302 to tumors containing cells expressing the receptor. In an embodiment of the present invention, a glycopeptide 1170 linked via a FSB linker 1220 to an illudin2 moiety 1302 acts as an AM for the glycopeptide receptor and directs the illudin2 moiety 1302 to tumors containing cells over-expressing the receptor compared to non tumor cells.

FSB Linker to Bind Illudin to a Lipid.

In an embodiment of the present invention, an illudin2 moiety 1302 linked via a FSB linker 1220 to a lipid 1180 with biological activity binds to receptors for the lipid 1180 and directs the illudin2 moiety 1302 to cell populations expressing the lipid. In an embodiment of the present invention, a lipid 1180 linked via a FSB linker 1220 to an illudin2 moiety 1302 acts as a ligand for the lipid receptor and directs the illudin2 moiety 1302 to tissues containing cells expressing the receptor. In an embodiment of the present invention, a lipid 1180 linked via a FSB linker 1220 to an illudin2 moiety 1302 acts as a ligand for the lipid receptor and directs the illudin2 moiety 1302 to tumors containing cells expressing the receptor. In an embodiment of the present invention, a lipid 1180 linked via a FSB linker 1220 to an illudin2 moiety 1302 acts as an AM for the lipid receptor and directs the illudin2 moiety 1302 to tissues containing cells expressing the receptor. In an embodiment of the present invention, a lipid 1180 linked via a FSB linker 1220 to an illudin2 moiety 1302 acts as an AM for the lipid receptor and directs the illudin2 moiety 1302 to tumors containing cells over-expressing the receptor compared to non tumor cells.

FSB Linker to Bind Illudin to a Peptide.

In an embodiment of the present invention, an illudin2 moiety 1302 linked via a FSB linker 1220 to a peptide 1190 with biological activity binds to the peptide receptor and directs the illudin2 moiety 1302 to cell populations expressing the receptor. In an embodiment of the present invention, a peptide 1190 linked via a FSB linker 1220 to an illudin2 moiety 1302 acts as a ligand for the peptide receptor and directs the illudin2 moiety 1302 to tissues containing cells expressing the receptor. In an embodiment of the present invention, a peptide 1190 linked via a FSB linker 1220 to an illudin2 moiety 1302 acts as a ligand for the peptide receptor and directs the illudin2 moiety 1302 to tumors containing cells expressing the receptor. In an embodiment of the present invention, a peptide 1190 linked via a FSB linker 1220 to an illudin2 moiety 1302 acts as an AM for the peptide receptor and directs the illudin2 moiety 1302 to tissues containing cells expressing the receptor. In an embodiment of the present invention, a peptide 1190 linked via a FSB linker 1220 to an illudin2 moiety 1302 acts as an AM for the peptide receptor and directs the illudin2 moiety 1302 to tumors containing cells expressing the receptor. In an embodiment of the present invention, a peptide 1190 linked via a FSB linker 1220 to an illudin2 moiety 1302 acts as an AM for the peptide receptor and directs the illudin2 moiety 1302 to tumors containing cells over-expressing the receptor compared to non tumor cells.

Linker to Bind Illudin2 to a Glycopeptide.

In an embodiment of the present invention, an illudin2 moiety 1302 linked via a traditional linker 1240 to a glycopeptide 1170 with biological activity binds to receptors for the glycopeptide 1170 and directs the illudin2 moiety 1302 to cell populations expressing the receptor. In an embodiment of the present invention, a glycopeptide 1170 linked via a traditional linker 1240 to an illudin2 moiety 1302 acts as a ligand for the glycopeptide receptor and directs the illudin2 moiety 1302 to tissues containing cells expressing the receptor. In an embodiment of the present invention, a glycopeptide 1170 linked via a traditional linker 1240 to an illudin2 moiety 1302 acts as a ligand for the glycopeptide receptor and directs the illudin2 moiety 1302 to tumors containing cells expressing the receptor.

Linker to Bind Illudin2 to a Lipid.

In an embodiment of the present invention, an illudin2 moiety 1302 linked via a traditional linker 1240 to a lipid 1180 with biological activity binds to receptors for the lipid 1180 and directs the illudin2 moiety 1302 to cell populations expressing the lipid receptor or lipid binding protein. In an embodiment of the present invention, a lipid 1180 linked via a traditional linker 1240 to an illudin2 moiety 1302 acts as a ligand for the lipid receptor and directs the illudin2 moiety 1302 to tissues containing cells expressing the receptor. In an embodiment of the present invention, a lipid 1180 linked via a traditional linker 1240 to an illudin2 moiety 1302 acts as a ligand for the lipid receptor and directs the illudin2 moiety 1302 to tumors containing cells expressing the receptor.

Linker to Bind Illudin2 to a Growth Factor.

In an embodiment of the present invention, an illudin2 moiety 1302 linked via a traditional linker 1240 to a growth factor 1120 with biological activity binds to receptors for the growth factor 1120 and directs the illudin2 moiety 1302 to cell populations expressing the growth factor receptor. In an embodiment of the present invention, a growth factor 1120 linked via a traditional linker 1240 to an illudin2 moiety 1302 acts as a ligand for the growth factor receptor and directs the illudin2 moiety 1302 to tissues containing cells expressing the receptor. In an embodiment of the present invention, a growth factor 1120 linked via a traditional linker 1240 to an illudin2 moiety 1302 acts as a ligand for the growth factor receptor and directs the illudin2 moiety 1302 to tumors containing cells expressing the receptor.

Linker to Bind Illudin2 to an Anti-Angiogenic Peptide.

In an embodiment of the present invention, an illudin2 moiety 1302 linked via a traditional linker 1240 to an anti-angiogenic peptide 1130 with biological activity binds to receptors for the anti-angiogenic peptide 1130 and directs the illudin2 moiety 1302 to cell populations expressing the anti-angiogenic peptide receptor. In an embodiment of the present invention, an anti-angiogenic peptide 1130 linked via a traditional linker 1240 to an illudin2 moiety 1302 acts as a ligand for the anti-angiogenic peptide receptor and directs the illudin2 moiety 1302 to tissues containing cells expressing the receptor. In an embodiment of the present invention, an anti-angiogenic peptide 1130 linked via a traditional linker 1240 to an illudin2 moiety 1302 acts as a ligand for the anti-angiogenic peptide receptor and directs the illudin2 moiety 1302 to tumors containing cells expressing the receptor.

Linker to Bind Illudin2 to a Steroid.

In an embodiment of the present invention, an illudin2 moiety 1302 linked via a traditional linker 1240 to a steroid 1140 with biological activity binds to receptors for the steroid 1140 and directs the illudin2 moiety 1302 to cell populations expressing the steroid receptor. In an embodiment of the present invention, a steroid 1140 linked via a traditional linker 1240 to an illudin2 moiety 1302 acts as a ligand for the steroid receptor and directs the illudin2 moiety 1302 to tissues containing cells expressing the receptor. In an embodiment of the present invention, a steroid 1140 linked via a traditional linker 1240 to an illudin2 moiety 1302 acts as a ligand for the steroid receptor and directs the illudin2 moiety 1302 to tumors containing cells expressing the receptor.

Linker to Bind Illudin2 to an Integrin Binding Protein.

In an embodiment of the present invention, an illudin2 moiety 1302 linked via a traditional linker 1240 to an integrin binding protein 1150 with biological activity binds to receptors for the integrin binding protein 1150 and directs the illudin2 moiety 1302 to cell populations expressing the integrin binding protein receptor. In an embodiment of the present invention, an integrin binding protein 1150 linked via a traditional linker 1240 to an illudin2 moiety 1302 acts as a ligand for the integrin binding protein receptor and directs the illudin2 moiety 1302 to tissues containing cells expressing the receptor. In an embodiment of the present invention, an integrin binding protein 1150 linked via a traditional linker 1240 to an illudin2 moiety 1302 acts as a ligand for the integrin binding protein receptor and directs the illudin2 moiety 1302 to tumors containing cells expressing the receptor.

Linker to Bind Illudin2 to Folate.

In an embodiment of the present invention, an illudin2 moiety 1302 linked via a traditional linker 1240 to folate 1185 binds to receptors for the folate 1185 and directs the illudin2 moiety 1302 to cell populations expressing the folate receptor. In an embodiment of the present invention, folate 1185 linked via a traditional linker 1240 to an illudin2 moiety 1302 acts as a ligand for the folate receptor and directs the illudin2 moiety 1302 to tissues containing cells expressing the receptor. In an embodiment of the present invention, folate 1185 linked via a traditional linker 1240 to an illudin2 moiety 1302 acts as a ligand for the folate receptor and directs the illudin2 moiety 1302 to tumors containing cells expressing the receptor.

Linker to Bind Illudin2 to a Peptide.

In an embodiment of the present invention, an illudin2 moiety 1302 linked via a traditional linker 1240 to a peptide 1190 with biological activity binds to the peptide receptor and directs the illudin2 moiety 1302 to cell populations expressing the receptor. In an embodiment of the present invention, a peptide 1190 linked via a traditional linker 1240 to an illudin2 moiety 1302 acts as a ligand for the peptide receptor and directs the illudin2 moiety 1302 to tissues containing cells expressing the receptor. In an embodiment of the present invention, a peptide 1190 linked via a traditional linker 1240 to an illudin2 moiety 1302 acts as a ligand for the peptide receptor and directs the illudin2 moiety 1302 to tumors containing cells expressing the receptor.

Mail Linker 1211.

Synthesis of mono-protected linkers. Maleimide or Maleic derivatives of acylfulvenes, Illudins and Syn-illudins can react directly with thiol groups on antibodies, proteins or with primary amines. When the Mall linker is used there is no need to attach the acylfulvene or illudin analog to linker as it is already incorporated into the analog (see FIG. 2S. FIG. 2T, FIG. 2U, and FIG. 2V). Both Illudin and Acylfulvene derivatives have been synthesized (e.g., analog 189, analog 190, analog 217, and analog 218, see also FIG. 19), and data demonstrating their in vitro activity and selectivity towards cells expressing a specific surface antigen are shown in FIG. 19.

Example 12

In an embodiment of the present invention, AMC's 189, 190, 217, 218 incorporating Mall linkers were synthesized. Unexpectedly, the AMC 189, 190, 217, 218 were found to be cytotoxic with nM activity (see Table XV).

In an embodiment of the present invention, an AMC in which analog 218 bound to an antibody using the Mall linker (FIG. 19) shows superior activity compared to current antibodies medicinally used (e.g. Herceptin). Table XV shows the cytotoxicity data for AMC's 189, 190, 217, 218 incorporating the Mall linker.

In an embodiment of the present invention, the Mail linker was attached to the acylfulvene. In this manner, the medicant-linker will bind directly to sulfhydryl groups on an AM, e.g., antibody or peptides containing a cysteine (with a sulfhydryl group). This novel medicant-linker allows the generation of toxin-peptide conjugates that can be cleaved by enzymes. Alternatively toxin-peptide conjugates can be prepared that will bind directly to tumor associated antigens (PMSA), specific integrins, or anti-angiogenic peptides.

Synthesis of Linkers.

The synthesis of medicant moieties bound to linkers can be carried out using the following strategies: React $R—NH_2$ with H—N═C═S to form isothiourea R—NH—C(═S)—$NH_2$. React $R—NH_2$ with H—N═C═O to form isourea R—NH—C(═O)—$NH_2$. React $R—NH_2$ with acyl azide to form RC(═O)NHR. React $R—NH_2$ with NHS ester to form RC(═O)NHR. Read amine with sulfonyl chloride to form sulfonamide bond R(S(═O)(═O)NHR. React amine with imidoester to form amidine linkage $RCH_2C(═NH_2)NHR$. React amine with succinic acid to make amide bond with carboxylate ion. React imidoester with amine to form amidine bond $RCH_2C(═NH_2+)NHR$ (see also Table X).

Azlactone Linker.

Reactions of carbodiimides such as dicyclohexylcarbodiimide (DCC) or diisopropylcarbodiimide (DIC) with a carboxylic acid yields a highly reactive O-acylisourea. During artificial protein synthesis (such as Fmoc solid-state synthesizers), the C-terminus is often used as the attachment site on which the amino acid monomers are added. To enhance the electrophilicity of carboxylate group, the negatively charged oxygen must first be "activated" into a better leaving group and carbodiimides can be used for this purpose. The negatively charged oxygen will act as a nucleophile, attacking the central carbon in DCC. DCC is temporarily attached to the former carboxylate group (which is now an ester group), making nucleophilic attack by an amino group (on the attaching amino acid) to the former C-terminus (carbonyl group) more efficient.

When the Illudin, Syn-Illudin, or Acylfulvene carboxylic acid analog is activated by DCC or DIC in the presence of an amino acid the DCC-activated carboxylate will react with the amino acid to form an azlacdone (FIG. 2P, FIG. 2Q, FIG. 2R, and FIG. 10). This amino acid-derived azlactone will react with primary amines, undergo ring opening, and forms an amide bond.

Example 13. Synthesis of Medicant 106

Illudin M (450 mg, 1.845 mmol, 1 equiv.), glutaric anhydride (2.10 g, 18.45 mmol, 10 equiv.) and DMAP (171 mg, 1.4 mmol, 0.76 equiv.) were dissolved in $CH_2Cl_2$ (5 mL) at room temperature. After 3.5 hours the mixture was taken up by $CH_2Cl_2$, which was washed with water, and brine in sequence. It was then dried and evaporated. The residue was eluted through a column (Hexane/EtOAc 4:1) to give analog 106 (365 mg, 55%) as a liquid. UV ($CHCl_2$) λ nm (E): 309 (3387).

Analog 106 was generated from illudin M as outlined in Example 13. The carboxylic acid derivative was activated using DCC/DMAP to synthesize steroid AFC's 107 and 109. In addition, Irofulven carboxylic acid derivative, analog 038 was activated using DCC/DMAP to produce analogs 108, 110, 111, and 112. In general, carboxylate group containing compounds can be activated using a carbodiimide in the presence of an amino acid to form an azlactone. The azlactone formed will react spontaneously with primary amine groups on an amino acid, a peptide, an antibody, a protein, or another drug, and undergo ring opening with the formation of an amide bond. For proteins, antibodies and peptides the amino acids capable of reacting with the azlactone derivative includes arginine and lysine.

To form an Illudin derived azlactone active drug-linker moiety, either analog 106 or analog 038 can be activated by DCC/DMAP in the presence of a small amino acid such as glycine to form the azlactone. DCC cannot be added without the presence of an amine containing target (such as the glycine) or the activated carboxylate reacts with another carboxylate to form a symmetrical anhydride. The azlactone formed will react spontaneously with primary amine groups on a peptide, an antibody, a protein, or a medicant.

Example 14. Activation of Analog 038 by DCC to Form Medicant-Azlactone

Part A: Production of Azlactone from carboxylate Acylfulvene analog: Analog 038 (58.5 mg, 0.2035 mmol), and DMAP (5 mg. 0.048 mmol) were dissolved in $CH_2Cl_2$ (5.6 mL) at 0° C. The desired amino acid (such as glycine) is added in an equimolar amount. Note that amino acids having substitutions on the C4 carbon (such as alpha-methyl glycine or 2-dimethylglycine) are preferred over conventional amino acids as substitution cannot occur at the C4 position after ring-opening and all nucleophilic coupling reactions must occur at the C5 position, resulting only in the desired amide-bond formation with the amine-containing molecule. To this solution was added $CH_2Cl_2$ solution of DCC (250 μL, 1 M, 0.244 mmol), stirred for 30 minutes, allowed to warm to room temperature then stirred for 1.5 hours. The filtrate was washed with dilute HCl (1.5%), saturated $NaHCO_3$ and brine in sequence. The organic phase was dried over $Na_2SO_4$, and evaporated. The residue was eluted through a column (100% $CH_2C2$ plus 0.5% methanol), to give the desired azlactone analog as a solid. Part B: Coupling of Azlactone to the protein component (reacting with primary amines on amino acids such as the one on lysine): The typical protein coupling reaction consists of the Azlactone suspended in buffer [25 mM sodium phosphate, 150 mM NaCl (pH 7.5)] and the desired amount of protein (20 μg to 5.0 mg) is added. The mixture is gently rocked for 60 minutes, then the reaction terminated by the addition of the blocking reagent, 1.0 ml of 1.0 M ethanolamine in 25 mM sodium pyrophosphate (titrated to pH 9.0 with HCl) Sample rocked gently for 5 minutes then the residual ethanolamine removed by dialysis or chromatography using pH 7.5 phosphate-NaCl buffer.

Example 15. Reaction of the Medicant-Azlactone Product with an Antibody

The azlactone derivative generated in Example 14 (note that other amino acids can be used in place of glycine) is then reacted with the desired peptide or protein or other compound containing a primary amino group at a 1:1 ratio in buffer (25 mM sodium phosphate, 150 mM sodium chloride, pH 7.5) with gentle rocking at room temperature for 60 minutes. The reaction is terminated by the addition of 1.0 mL of 25 mM ethanolamine (titrated to pH 9.00) with rocking for 5 minutes at room temperature). The drug-azlactone-ligand product can be purified by column chromatography or dialysis to remove the ethanolamine by-product.

Azlactone linker to bind Illudin2 to a Glycopeptide.

In an embodiment of the present invention, an illudin2 moiety 1302 linked via an azlactone linker 1230 to a glycopeptide 1170 with biological activity binds to receptors for the glycopeptide 1170 and directs the illudin2 moiety 1302 to cell populations expressing the receptor. In an embodiment of the present invention, a glycopeptide 1170 linked via an azlactone linker 1230 to an illudin2 moiety 1302 acts as an AM for the glycopeptide receptor and directs the illudin2 moiety 1302 to tissues containing cells expressing the receptor. In an embodiment of the present invention, a glycopeptide 1170 linked via an azlactone linker 1230 to an illudin2 moiety 1302 acts as an AM for the glycopeptide receptor and directs the illudin2 moiety 1302 to tumors containing cells expressing the receptor. In an embodiment of the present invention, a glycopeptide 1170 linked via an azlactone linker 1230 to an illudin2 moiety 1302 acts as an AM for the glycopeptide receptor and directs the illudin2 moiety 1302 to tumors containing cells over-expressing the receptor compared to non tumor cells Azlactone Linker to Bind Illudin2 to a Lipid.

In an embodiment of the present invention, an illudin2 moiety 1302 linked via an azlactone linker 1230 to a lipid 1180 with biological activity binds to receptors for the lipid 1180 and directs the illudin2 moiety 1302 to cell populations expressing the lipid. In an embodiment of the present invention, a lipid 1180 linked via an azlactone linker 1230 to an illudin2 moiety 1302 acts as an AM for the lipid receptor and directs the illudin2 moiety 1302 to tissues containing cells expressing the receptor. In an embodiment of the present invention, a lipid 1180 linked via an azlactone linker 1230 to an illudin2 moiety 1302 acts as an AM for the lipid receptor and directs the illudin2 moiety 1302 to tumors containing cells over-expressing the receptor compared to non tumor cells.

Azlactone Linker to Bind Illudin2 to a Peptide.

In an embodiment of the present invention, an illudin2 moiety 1302 linked via an azlactone linker 1230 to a peptide 1190 with biological activity binds to the peptide receptor and directs the illudin2 moiety 1302 to cell populations expressing the receptor. In an embodiment of the present invention, a peptide 1190 linked via an azlactone linker 1230 to an illudin2 moiety 1302 acts as an AM for the peptide receptor and directs the illudin2 moiety 1302 to tissues containing cells expressing the receptor. In an embodiment of the present invention, a peptide 1190 linked via an azlactone linker 1230 to an illudin2 moiety 1302 acts as an AM for the peptide receptor and directs the illudin2 moiety 1302 to tumors containing cells expressing the receptor. In an embodiment of the present invention, a peptide 1190 linked via an azlactone linker 1230 to an illudin2 moiety 1302 acts as an AM for the peptide receptor and directs the illudin2 moiety 1302 to tumors containing cells over-expressing the receptor compared to non tumor cells.

Azolactone Linker to Bind Illudin2 to a Steroid.

In an embodiment of the present invention, an illudin2 moiety 1302 linked via an azlactone linker 1230 to a steroid 1140 binds to receptors for the steroid and directs the illudin2 moiety 1302 to cell populations expressing the receptor. In an embodiment of the present invention, a steroid 1140 linked via an azlactone linker 1230 to an illudin2 moiety 1302 acts as an AM for the steroid hormone receptor and directs the illudin2 moiety 1302 to tissues containing cells expressing the receptor. In an embodiment of the present invention, a steroid 1140 linked via an azlactone linker 1230 to an illudin2 moiety 1302 acts as an AM for the steroid hormone receptor and directs the illudin2 moiety 1302 to tumors containing cells expressing the receptor. In an embodiment of the present invention, a steroid 1140 linked via an azlactone linker 1230 to an illudin2 moiety 1302 acts as an AM for the steroid hormone receptor and directs the illudin2 moiety 1302 to tumors containing cells over-expressing the receptor compared to non tumor cells.

Azlactone Linker to Bind an Antibody to a Protein Toxin.

In an embodiment of the present invention, an antibody 1110 is bound to a protein toxin 1330 with an azlactone linker 1230. In an embodiment of the present invention, an antibody 1110 directs the protein toxin 1330 to cell populations expressing the receptor. In an embodiment of the present invention, the antibody 1110 with an azlactone linker 1230 to a protein toxin 1330 acts as an AM for a receptor and directs the protein toxin 1330 to tissues containing cells expressing the receptor. In an embodiment of the present invention, an antibody 1110 with an azlactone linker 1230 to the protein toxin 1330 acts as an AM for a receptor and directs the protein toxin 1330 to tumors containing cells expressing the receptor. In an embodiment of the present invention, an antibody 1110 with an azlactone linker 1230 to the protein toxin 1330 acts as an AM for a receptor and directs the protein toxin 1330 to tumors containing cells over-expressing the receptor compared to non tumor cells.

Azlactone Linker to Bind an Growth Factor to a Protein Toxin.

In an embodiment of the present invention, a growth factor 1120 is bound to a protein toxin 1330 with an azlactone linker 1230. In an embodiment of the present invention, the growth factor 1120 directs the protein toxin 1330 to cell populations expressing the receptor to the growth factor 1120. In an embodiment of the present invention, the growth factor 1120 with an azlactone linker 1230 to a protein toxin 1330 acts as an AM for a receptor to the growth factor 1120 and directs the protein toxin 1330 to tissues containing cells expressing the receptor. In an embodiment of the present invention, the growth factor 1120 with an azlactone linker 1230 to the protein toxin 1330 acts as an AM for the growth factor receptor and directs the protein toxin 1330 to tumors containing cells over-expressing the receptor compared to non tumor cells.

Azlactone linker to bind an Antibody to a Medicant.

In an embodiment of the present invention, an antibody 1110 is bound to a medicant 1350 with an azlactone linker 1230. In an embodiment of the present invention, an antibody 1110 directs the medicant 1350 to cell populations expressing the receptor. In an embodiment of the present invention, the antibody 1110 with an azlactone linker 1230 to the medicant 1350 acts as an AM for a receptor and directs the medicant 1350 to tissues containing cells expressing the receptor. In an embodiment of the present invention, an antibody 1110 with an azlactone linker 1230 to the medicant 1350 acts as an AM for a receptor and directs the medicant 1350 to tumors containing cells expressing the receptor. In an embodiment of the present invention, an antibody 1110 with an azlactone linker 1230 to the medicant 1350 acts as an AM for a receptor and directs the medicant 1350 to tumors containing cells over-expressing the receptor compared to non tumor cells.

Azlactone Linker to Bind an Growth Factor to a Medicant.

In an embodiment of the present invention, a growth factor 1120 is bound to a medicant 1350 with an azlactone linker 1230. In an embodiment of the present invention, the growth factor 1120 directs the medicant 1350 to cell populations expressing the receptor to the growth factor 1120. In an embodiment of the present invention, the growth factor 1120 with an azlactone linker 1230 to a medicant 1350 acts as an AM for a receptor to the growth factor 1120 and directs the medicant 1350 to tissues containing cells expressing the receptor. In an embodiment of the present invention, the growth factor 1120 with an azlactone linker 1230 to the medicant 1350 acts as an AM for a receptor and directs the medicant 1350 to tumors containing cells expressing the receptor for the growth factor 1120. In an embodiment of the present invention, the growth factor 1120 with an azlactone linker 1230 to the medicant 1350 acts as an AM for a receptor and directs the medicant 1350 to tumors containing cells over-expressing the receptor compared to non tumor cells.

Example 16. Synthesis of Medicant 114

$(CH_3)_3S(O)I$ (110 mg, 0.4 mmol) and tBuOK (50 mg, 0.4 mmol) were dissolved in anhydrous DMSO (1 mL) and stirred at room temperature for 40 minutes at room temperature. Then analog 10 (50 mg, 0.2 mmol) in 1.0 mL of DMSO was added via syringe, and stirred for 3 hours. Reaction quenched with saturated $NH_4Cl$ (0 mL), extracted with $CH_2Cl_2$, dried over $Na_2SO_4$, concentrated then chromatographed (2:3 hexane:ethyl acetate) to yield analog 114 (20 mg, 50% yield).

Example 17. Synthesis of Medicant 115

Analog 10 (40 mg) and $NAHCO_3$(50 mg) are dissolved in 10 mL of 1:1 Ethanol and water mixture, then hydroxylamine hydrochloride (20 mg) is added, stirred for 30 minutes at room temperature. Water and ethyl acetate (1:1 mixture) is added, stirred, the organic layer is recovered, washed with saturated $NaHCO_3$ and then brine, dried over $Na_2SO_4$, concentrated then chromatographed (2:3 ethyl acetate: hexane) to yield analog 115.

Example 18. Synthesis of Medicant 116

$SeO_2$ (45 mg) and 500 mg SiO2 transferred into a dried RB flask, 5 mL of $CH_2Cl_2$ added, and stirred for 1 hour under nitrogen. Then 250 FL of tBuO$_2$H added and stirred for 15 minutes. Then 100 mg of Irofulven in 1 mL CH$_2$Cl$_2$ is added, and stirred for 3 hours at room temperature under a nitrogen atmosphere. Product is filtered, wash twice with water (25 mL), twice with brine (25 mL), dried over Na$_2$SO$_4$ and concentrated then chromatographed (4:1 hexane:ethyl acetate) to yield analog 116.

Example 19. Synthesis of Medicant 116

Analog 117: Illudin S (100 mg, 0.378 mmol) and glutaric anhydride (215.46 mg, 1.89 mmol) are dissolved in 5 mL of CH$_2$Cl$_2$, and DMAP added (92.23 mg, 0.756 mmol), and stirred for 2 hours at room temperature. The CH$_2$Cl$_2$ is evaporated, 5 mL of water is added, and stirred for 1 hour. The solution is extracted with 10 mL of CH$_2$Cl$_2$, washed with water, dried over Na$_2$SO$_4$ and concentrated to yield analog 117 (120 mg).

Example 20. Synthesis of Analog 118

Analog 302 (75 mg), glutaric anhydride (20 mg) are dissolved in 5 mL of CH$_2$Cl$_2$, and DMAP added (42 mg), and stirred for 2 hours at room temperature. The CH$_2$Cl$_2$ is evaporated, 5 ml, of water added, and stirred for 1 hour. Solution is extracted with 10 mL of CH$_2$Cl$_2$, washed with water, dried over Na$_2$SO$_4$ and concentrated to yield analog 118 (120 mg).

Example 21. Synthesis of Analog 119

Analog 114 (10 mg) is dissolved in 1.5 mL of acetone with 1.0 mL of 4NH$_2$SO$_4$, and contents stirred for 1.5 hours at room temperature. Then 10 mL of CH$_2$Cl$_2$ and 10 mL of water are added, extracted, and the organic layer recovered which is then washed with saturated NaHCO$_3$ and saline, dried over Na$_2$SO$_4$ and concentrated, and analog 119 recovered (analog 128 is a byproduct).

Example 22. Synthesis of Analog 120

Analog 10 (50 mg), NaHCO$_3$ are dissolved in 10 mL of 1:1 mixture of water and ethanol, then NH$_2$NH$_2$ (0.5 mL added with stirring at room temperature for one hour. The solution is extracted with CH$_2$C$_h$ twice, the organic layer recovered, washed with water, then NaHCO$_3$ solution, dried over Na$_2$SO$_4$, and evaporated to yield analog 120 (30 mg).

Example 23. Synthesis of Analog 121

Analog 10 (50 mg) and NaCO$_2$CH$_3$ (75 mg) are dissolved in 10 ml of 1:1 mixture of water and ethanol 1:1, then semicarbazide hydrochloride salt (H$_2$NNHCONH$_2$·HCl, 50 mg) added, and stirred for 2 hours at room temperature. The solution is extracted with CH$_2$Cl$_2$ twice, the organic layer recovered, washed with water, then NaHCO$_3$ solution, dried over Na$_2$SO$_4$, and evaporated then chromatographed (5% methanol in ethyl acetate) to yield analog 121.

Example 24. Synthesis of Analog 122

Analog 10 (50 mg) and NaCO$_2$CH$_3$ (75 mg) are dissolved in 5 mL of ethanol, then phenylhydrazide (50 mg) is added, stirred for 1 hour at room temperature. Then 5 mL of water is added, followed by extraction with ethyl acetate, washed with water, dried over Na$_2$SO$_4$ and concentrated and chromatographed (5% methanol in ethyl acetate) to yield analog 122.

Example 25. Synthesis of Analog 123

Analog 10 (50 mg) and NaCO$_2$CH$_3$ (75 mg) are dissolved in 10 mL of 1:1 water and ethanol, then H$_2$NNHTS (H$_2$NNHS(=O)$_2$(phenyl)methyl, 50 mg) is added, stirred for 2 hour at room temperature. Then 5 mL of water is added, followed by extraction with ethyl acetate, washed with water, dried over Na$_2$SO$_4$ and concentrated and chromatographed (5% methanol in ethyl acetate) to yield analog 123.

Example 26. Synthesis of Analog 124

Analog 115 (15 mg) and NaOAc (15 mg) are dissolved in acetic anhydride (1 mL) and stirred for 2 hours, then sodium acetate (300 mg) is added with stirring for 1 hour. Then the mixture is chromatographed (10% ethyl acetate in hexane) to give analog 124.

Example 27. Synthesis of Analog 125

Analog 10 (50 mg) and NaCO$_2$CH$_3$ (75 mg) are dissolved in 5 mL of ethanol, then the dinitrophenylhydrazine (50 mg) is added, stirred for 1 hour at room temperature. Then 5 mL of water is added, followed by extraction with ethyl acetate, washed with water, dried over Na$_2$SO$_4$ and concentrated and chromatographed (5% methanol in ethyl acetate) to yield analog 125.

Example 28. Synthesis of Analog 126

Analog 11 (40 mg), hydroxylamine (20 mg), NaHCO$_3$ (50 mg) are dissolved in 10 mL of ethanol and water (1:1) then stirred at room temperature for 90 minutes. Then the mixture is extracted with water (10 mL) and ethyl acetate (20 mL), the organic layer washed with saturated NaHCO$_3$ then brine, dried over Na$_2$SO$_4$ and concentrated, then chromatographed (2:3 ethyl acetate:hexane) to give analog 126.

Example 29. Synthesis of Analog 127

Analog 10 (100 mg) and NH$_4$Cl (1.5 equivalent) are dissolved in 1,4-dioxane (5 mL) and water (0.2 mL), then NaCN added (1.3 equivalents), stirred for 1 hour at room temperature. Then ethyl ether (20 mL) was added, the organic layer recovered, washed with water, washed with brine, then dried over Na$_2$SO$_4$, then chromatographed (2:3 ethyl acetate:hexane) to yield analog 127.

Example 30. Synthesis of Analog 128

Analog 114 (10 mg) is dissolved in 1.5 mL of acetone with 1.0 mL of 4N H$_2$SO$_4$, and contents stirred for 1.5 hours at room temperature. Then 10 ml of CH$_2$Cl$_2$ and 10 mL of water are added, extracted, and the organic layer recovered which is then washed with saturated NaHCO$_3$ and saline, dried over Na$_2$SO$_4$ and concentrated, and analog 128 recovered (analog 119 is a byproduct).

Example 31. Synthesis of Analog 129

Acylfulvene (200 mg) is dissolved in anhydrous THF (10 ml) at room temperature then NaBH, (100 mg) is added slowly for 30 minutes. Reaction is quenched with 1 mL of

Example 32. Analog 141

Analog 129 (200 mg) is dissolved in $CH_2Cl_2$ at room temperature, then 1,4-dimethyl but-2-ynedioate (1.1 equivalent) is added slowly and mixture allowed to react for one hour, then evaporated to yield analog 141. If need be the compound can be purified by chromatography (1:1 ethyl acetate:hexane).

Example 33. Synthesis of Analog 142

Analog 141 (100 mg) is dissolved in $CH_2Cl_2$ at room temperature then Dess-Martin Periodinane reagent (200 mg) added with stirring for 1 hour to yield analog 142. If need be the compound can be purified by chromatography (1:1 ethyl acetate:hexane).

Example 34. Synthesis of Analog 146

Analog 127 (35 mg, 0.117 mmol), DMAP (5 mg), and diimidazole (22 mg, 1.2 eq) were dissolved in anhydrous $CH_2Cl_2$ under an argon atmosphere, and stirred for 30 minutes. The solution was cooled to 20° C. then tributyl tin hydride ($Bu_3SnH$, 0.6 mL) and azobis isobutylnitrite (4 mg) were added with stirring for 30 minutes. The mixture was filtered then chromatographed (1:10 ethyl acetate:hexane) to remove impurities and starting materials, then chromatographed (2:3 ethyl acetate:hexane) to yield analog 146.

Example 35. Synthesis of Analog 147

Irofulven (10 mg) is dissolved in 3 mL of acetone and 1 M $H_2SO_4$ solution (1:1) with stirring at room temperature and 2-Mercaptobenzothiazole (1 equivalent) is added, stirred for 2 hours, then partitioned between ethyl acetate and water. The organic extract is washed with saturated $NaHCO_3$ and saline until neutral, dried over $MgSO_4$, concentrated then chromatographed (1:1 ethyl acetate:hexane) to give analog 147.

Example 36. Synthesis of Analog 148

Irofulven (10 mg) is dissolved in 3 mL of acetone and 1 M $H_2SO_4$ solution (1:1) with stirring at room temperature and 2-Mercaptobenzoxazole (1 equivalent) is added, stirred for 2 hours, then partitioned between ethyl acetate and water. The organic extract is washed with saturated $NaHCO_3$ and saline until neutral, dried over $MgSO_4$, concentrated then chromatographed (1:1 Ethyl acetate:hexane) to give analog 148.

Example 37. Synthesis of Analog 149

Irofulven (10 mg) is dissolved in 4 mL of acetone and 1 M $H_2SO_4$ solution (1:1) with stirring at room temperature and thiol-imidazole (1 equivalent) is added, stirred for 24 hours, then partitioned between ethyl acetate and water. The organic extract is washed with saturated $NaHCO_3$ and saline until neutral, dried over $MgSO_4$, concentrated then chromatographed (1:1 ethyl acetate:hexane) to give analog 149.

Example 38. Synthesis of Analog 150

Irofulven (10 mg) is dissolved in 4 mL of acetone and 1 M $H_2SO_4$ solution (1:1) with stirring at room temperature and 2-mercapto-5-methylbenzimidazole (1 equivalent) is added, stirred for 12 hours, then partitioned between ethyl acetate and water. The organic extract is washed with saturated $NaHCO_3$ and saline until neutral, dried over $MgSO_4$, concentrated then chromatographed (1:1 ethyl acetate:hexane) to give analog 150.

Example 39. Synthesis of Analog 151

Irofulven (10 mg) is dissolved in 3 mL of acetone and 1 M $H_2SO_4$ solution (1:1) with stirring at room temperature and 1-phenyl-1,2,3,4-tetraazole-5-thiol (1 equivalent) is added, stirred for 2 hours, then partitioned between ethyl acetate and water. The organic extract is washed with saturated $NaHCO_3$ and saline until neutral, dried over $MgSO_4$, concentrated then chromatographed (1:1 ethyl acetate:hexane) to give analog 151.

Example 40. Synthesis of Analog 152

Irofulven (10 mg) is dissolved in 3 mL of acetone and 1 M $H_2SO_4$ solution (1:1) with stirring at room temperature and 2-mercapto-5-nitro benzimidazole (1 equivalent) is added, stirred for 2 hours, then partitioned between ethyl acetate and water. The organic extract is washed with saturated $NaHCO_3$ and saline until neutral, dried over $MgSO_4$, concentrated then chromatographed (1:1 ethyl acetate:hexane) to give analog 152.

Example 41. Synthesis of Analog 153

Irofulven (10 mg) is dissolved in 3 mL of acetone and 1 M $H_2SO_4$ solution (1:1) with stirring at room temperature and 1, 2, 4-Triazole-3-thiol (1 equivalent) is added, stirred for 2 hours, then partitioned between ethyl acetate and water. The organic extract is washed with saturated $NaHCO_3$ and saline until neutral, dried over $MgSO_4$, concentrated then chromatographed (1:1 ethyl acetate:hexane) to give analog 153.

Example 42. Synthesis of Analog 154

Irofulven (10 mg) is dissolved in 3 mL of acetone and 1 M $H_2SO_4$ solution (1:1) with stirring at room temperature and 2-sulfanylpteridin-4-ol (1 equivalent) is added, stirred for 2 hours, then partitioned between ethyl acetate and water. The organic extract is washed with saturated $NaHCO_3$ and saline until neutral, dried over $MgSO_4$, concentrated then chromatographed (1:1 ethyl acetate:hexane) to give analog 154.

Example 43. Synthesis of Analog 155

Irofulven (10 mg) is dissolved in 3 mL of acetone and 1 M $H_2SO_4$ solution (1:1) with stirring at room temperature and 4-(5-sulfanyl-1H-1,2,3,4-tetrazol-1-yl)phenol (1 equivalent) is added, stirred for 2 hours, then partitioned between ethyl acetate and water. The organic extract is washed with saturated $NaHCO_3$ and saline until neutral, dried over $MgSO_4$, concentrated then chromatographed (1:1 ethyl acetate:hexane) to give analog 155.

Example 44. Synthesis of Analog 156

Irofulven (10 mg) is dissolved in 3 mL of acetone and 1 M $H_2SO_4$ solution (1:1) with stirring at room temperature and 4-(5-sulfanyl-1-1,2,3,4-tetrazol-1-yl)benzoic acid (1 water then extracted with ethyl acetate (10 mL), washed with saturated $NaHCO_3$, and dried over $Na_2SO_4$, then concentrated to yield analog 129. If need be the compound can be purified by chromatography (1:1 ethyl acetate:hexane).

equivalent) is added, stirred for 2 hours, then partitioned between ethyl acetate and water. The organic extract is washed with saturated NaHCO$_3$ and saline until neutral, dried over MgSO$_4$, concentrated then chromatographed (1:1 ethyl acetate:hexane) to give analog 156.

Example 45. Synthesis of Analog 159

Illudin S (300 mg) is dissolved acetic anhydride (6 mL) and stirred for 15 minutes, then sodium acetate (300 mg) is added with stirring for 1 hour. Water (6 mL) is added, ethyl acetate extraction performed, washed with sodium bicarbonate solution, dried over Na$_2$SO$_4$, concentrated then chromatographed (2:3 ethyl acetate:hexane) to give analog 159.

Example 46. Synthesis of Analog 160

Analog 159 (60 mg) is dissolved in dry CH$_2$Cl$_2$ (6 mL) under nitrogen at room temperature and glutaric anhydride (100 mg) with DMAP (20 mg) is added with stirring for 30 minutes. The solvent is removed, water added, extracted with CH$_2$Cl$_2$, washed with water, dried over Na$_2$SO$_4$, concentrated then chromatographed (2:3 ethyl acetate:hexane) to give analog 160.

Example 47. Synthesis of Analog 161

Dehydroilludin S (300 mg) is dissolved acetic anhydride (6 mL) and stirred for 15 minutes, then sodium acetate (300 mg) is added with stirring for 1 hour. Water (6 mL) is added, ethyl acetate extraction performed, washed with sodium bicarbonate solution, dried over Na$_2$SO$_4$, concentrated then chromatographed (2:3 ethyl acetate:hexane) to give analog 161.

Example 48. Synthesis of Analog 162

Dehydroilludin S (60 mg) is dissolved in dry CH$_2$Cl$_2$ (6 mL) under nitrogen at room temperature and glutaric anhydride (150 mg) with DMAP (50 mg) is added with stirring for 30 minutes. The solvent is removed, water added, extracted with CH$_2$Cl$_2$, washed with water, dried over Na$_2$SO$_4$, concentrated then chromatographed (2:3 ethyl acetate:hexane) to give analog 162.

Example 49. Synthesis of Analog 163

Analog 159 (20.25 mg). DMAP (20 mg) are dissolved in dry CH$_2$Cl$_2$ (6 mL) at 0° C. under nitrogen atmosphere and stirred for 10 minutes. Then chloroacetyl chloride (0.2 mL) is added slowly and the mixture stirred for 30 minutes, warmed to room temperature with stirring over 1 5 minutes. Then water (6 mL) is added, mixed, and then extracted with CH$_2$Cl$_2$. The organic layer is washed with saturated NaHCO$_3$ followed by a saline wash, dried over Na$_2$SO$_4$ then chromatographed (2:3 ethyl acetate:hexane) to yield analog 163 (60% yield).

Example 50. Synthesis of Analog 164

Irofulven (50 mg), DMAP (40 mg) are dissolved in dry CH$_2$Cl$_2$ (6 mL) at 0° C. under nitrogen atmosphere and stirred for 10 minutes. Then chloroacetyl chloride (0.2 mL) is added slowly and the mixture stirred for 30 minutes, warmed to room temperature with stirring over 1 5 minutes. Then water (6 mL) is added, mixed, and then extracted with CH$_2$Cl$_2$. The organic layer is washed with saturated NaHCO$_3$ followed by a saline wash, dried over Na$_2$SO$_4$ then chromatographed (2:3 ethyl acetate:hexane) to yield analog 164 (60% yield).

Example 51. Synthesis of Analog 165

Analog 164 (40 mg) is dissolved in dry CH$_2$Cl$_2$ (6 mL) at room temperature under nitrogen atmosphere and stirred for 10 minutes. Then 1 mL of morpholine is added drop wise, with stirring for 30 minutes. The reaction is diluted with water (6 mL), extracted with CH$_2$Cl$_2$ (12 mL). The organic layer is washed with saturated NaHCO$_3$ then washed with saline, dried over Na$_2$SO$_4$ and chromatographed (2:3 ethyl acetate:hexane) to yield 165 (35% yield).

Example 52. Synthesis of Analog 166 and Analog 167 (Prepared Together)

Analog 160 (30 mg) is dissolved in methanol (4 mL) at 0° C., and 1N H$_2$SO$_4$ (1 mL) is added with stirring for 1 hour. Water (6 mL) is added, extracted with ethyl acetate, washed with NaHCO$_3$ then a brine solution, dried over MgSO$_4$, concentrated and then chromatographed (1:1 ethyl acetate:hexane) to yield analogs 166 and 167 in equal amounts.

Example 53. Synthesis of Analog 168

Analog 162 (20 mg) is dissolved in methanol (5 mL) at 0° C. and stirred for 10 minutes, then 1 mL of 1N H$_2$SO$_4$ in methanol is slowly added, followed by stirring for 30 minutes. Water is added, followed by an ethyl acetate extraction, washed with NaHCO$_3$ then a brine solution, dried over Na$_2$SO$_4$, concentrated then chromatographed (1:1 ethyl acetate:hexane) to yield analog 168.

Example 54. Synthesis of Analog 169

Dehydroilludin S (20 mg), DMAP (20 mg) are dissolved in dry CH$_2$Cl$_2$ (6 mL) at 0° C. under nitrogen atmosphere and stirred for 10 minutes. Then chloroacetyl chloride (0.2 mL) is added slowly and the mixture stirred for 30 minutes, warmed to room temperature with stirring over 15 minutes. Then water (6 mL) is added, mixed, then extracted with CH$_2$Cl$_2$. The organic layer is washed with saturated NaHCO$_3$ followed by a saline wash, dried over Na$_2$SO$_4$ then chromatographed (2:3 ethyl acetate:hexane) to yield analog 169 (60% yield).

Example 55. Synthesis of Analog 176

To a solution of analog 9 (266 umol), Boc protected leucine amino acid (300 umol) and DMAP (dimethylaminopyridine, 110 umol) in CH$_2$Cl$_2$ (2.5 mL) at ° C. is added DCC (dicyclohexylcarbodiimide; 1.0M in CH$_2$Cl$_2$, 300 umol)/. The mixture is stirred for 35 minutes then 5 µL of water added to quench the reaction. The mixture is diluted with hexane and precipitate filtered off, solvent evaporated off and crude product chromatographed (2:1 hexanes-ethyl acetate) to give the desired Boc-protected derivative of 176 at 80% yield. The Boc group is removed by dissolving the Boc-protected derivative in a 1:1 mixture (2.0 mL) of 1,4-dioxane and 2M H$_2$SO$_4$, stirred for 18 hours, then partitioned between ethyl acetate and water. Aqueous layer is extracted with ethyl acetate and extracts discarded. Aqueous layer is neutralized with saturated NaHCO$_3$ and extracted again with ethyl acetate. Organic layer is washed with brine, dried with MgSO$_3$, solvent evaporated to yield the analog 9 amino acid derivative. As the amine derivative is unstable over prolonged periods of time it can be converted to the very stable trifluoroacetate salt by dissolving in CH$_2$Cl$_2$ adding the equal molar amount of trifluoroacetic acid and concentrating to dryness.

Example 56. Synthesis of Analog 178

Analog 9 (15 mg) is dissolved in CH$_2$Cl$_2$ (2.0 mL) under a nitrogen atmosphere at room temperature, succinic anhydride (1 equivalent) is added, followed by DMAP (10 mg) and stirring for 30 minutes. Solvent is removed and product recrystallized to give analog 178.

Example 57. Synthesis of Analog 179

To a solution of Analog 9 (266 μmol), Boc protected glycine amino acid (300 umol) and DMAP (dimethylaminopyridine, 110 umol) in CH$_2$Cl$_2$ (2.5 mL) at 0° C. is added DCC (dicyclohexylcarbodiimide; 1.0 M in CH$_2$Cl$_2$, 300 umol)/. The mixture is stirred for 35 minutes then 5 μL of water added to quench the reaction. The mixture is diluted with hexane and precipitate filtered off, solvent evaporated off and crude product chromatographed (2:1 hexanes-ethyl acetate) to give the desired Boc-protected derivative of 179 at 80% yield. The Hoc group is removed by dissolving the Boc-protected derivative in a 1:1 mixture (2.0 mL) of 1,4-dioxane and 2M H$_2$SO$_4$, stirred for 18 hours, then partitioned between ethyl acetate and water. Aqueous layer is extracted with ethyl acetate and extracts discarded. Aqueous layer is neutralized with saturated NaHCO$_3$ and extracted again with ethyl acetate. Organic layer is washed with brine, dried with MgSO$_3$, solvent evaporated to yield the analog 9 amino acid derivative. As the amine derivative is unstable over prolonged periods of time it can be converted to the very stable trifluoroacetate salt by dissolving in CH$_2$Cl$_2$ adding the equal molar amount of trifluoroacetic acid and concentrating to dryness.

Example 58. Synthesis of Analog 180

Illudin M (50 mg) is dissolved in dry benzene (10 mL) under a nitrogen atmosphere, and vanadyl acetylacetonate (VO(acac)$_2$, 1.2 mg) is added. Then t-butyl hydroperoxide (t-BuO$_2$H, 0.5 mL) in benzene is added drop wise with stirring for 30 minutes. A saturated solution of Na$_2$S$_2$O$_3$ is added (10 mL), then extraction with ethyl acetate, and the organic layer is dried over Na$_2$SO$_4$, concentrated then chromatographed) (1:1 ethyl acetate:hexane) to give analog 180.

Example 59. Synthesis of Analog 181

Analog 159 (40 mg) was dissolved in dry benzene (8 mL) under a nitrogen atmosphere, and vanadyl acetylacetonate (VO(acac)$_2$, 2 mg) was added. Then t-butyl hydroperoxide (t-BuO$_2$H, 0.5 mL) in benzene was added drop wise with stirring for 30 minutes. A saturated solution of Na$_2$S$_2$O$_3$ is added (10 mL), then extraction with ethyl acetate, followed by a brine wash, and the organic layer was then dried over Na$_2$SO$_4$, concentrated then chromatographed) (1:1 ethyl acetate:hexane) to give analog 181.

Example 60. Synthesis of Analog 189

To a solution of Irofulven (1.00 equivalent), maleimide (1.71 equivalent), triphenylphosphine (PPh$_3$, 1.71 equivalent) in 1.5 mL of THE at −40° C., is added DEAD (diethylazodicarboxylate; 1.68 equivalent). The mixture is stirred for 30 minutes then water (20 μL) added to quench the reaction. The mixture is concentrated on a rotary evaporator and crude product is chromatographed on a silica column (10:3 hexanes:ethyl acetate) to yield an orange compound (20% yield).

Example 61. Synthesis of Analog 190

To a solution of analog 9 (6-hydroxy-n-propylacylfulvene-structure below, 1.00 equivalent), maleimide (1.23 equivalent), triphenylphosphine (PPh$_3$, 1.13 equivalent) in 2.5 mL of THF at −40° C., is added DIAD (diisopropylcarbodiimide; 1.44 equivalent). The mixture is stirred for 1 hour then water (10 μL) added to quench the reaction. The mixture is concentrated on a rotary evaporator and crude product is chromatographed on a silica column (5:1→10:3 hexanes:ethyl acetate) to yield an orange compound (15% yield).

Example 62. Synthesis of Analog 196

To a solution of analog 9 (266 umol), Hoc protected proline amino acid (300 umol) and DMAP (dimethylaminopyridine, 110 umol) in CH$_2$Cl$_2$ (2.5 mL) at 0° C. is added DCC (dicyclohexylcarbodiimide; 1.0 M in CH$_2$Cl$_2$, 300 umol)/. The mixture is stirred for 35 minutes then 5 μL of water added to quench the reaction. The mixture is diluted with hexane and precipitate filtered off, solvent evaporated off and crude product chromatographed (2:1 hexanes-ethyl acetate) to give the desired Boc-protected derivative of 1% at 80% yield. The Hoc group is removed by dissolving the Boc-protected derivative in a 1:1 mixture (2.0 mL) of 1,4-dioxane and 2M H$_2$SO$_4$, stirred for 18 hours, then partitioned between ethyl acetate and water. Aqueous layer is extracted with ethyl acetate and extracts discarded. Aqueous layer is neutralized with saturated NaHCO$_3$ and extracted again with ethyl acetate. Organic layer is washed with brine, dried with MgSOS$_3$, solvent evaporated to yield the analog 9 amino acid derivative. As the amine derivative is unstable over prolonged periods of time it can be converted to the very stable trifluoroacetate salt by dissolving in Cl$_2$C$_2$ adding the equal molar amount of trifluoroacetic acid and concentrating to dryness.

Example 63. Synthesis of Analog 198

Irofulven (26.3 mg, 107 umol), β-nitrophenol (16.2 mg, 116 umol) and PPh$_3$ (30.8 mg, 117 umol) were dissolved in anhydrous TH (1.5 mL) at −40° C., the DEAD (25 μL 160 umol) was added, followed by stirring for 30 minutes, then diluted with hexane. The precipitate was filtered off, solvent evaporated, and crude product chromatographed (6:1→2:1 hexane:ethyl acetate) to give analog 198 as a yellow product (18.5 mg, 47%).

Example 64 Analogs 199 and 200 (Prepared Together)

Irofulven (25.2 mg, 102 umol), phenol (11.5 mg, 122 umol) and PPh$_3$ (29.1 mg, 117 μmol) were dissolved in anhydrous THF (1.0 mL) at −40° C., the DEAD (25 μL, 192 μmol) was added, followed by stirring for 30 minutes, then diluted with hexane. The precipitate was filtered off, solvent evaporated, and crude product chromatographed (6:1→3:1 hexane:ethyl acetate) to give analog 199 (8.2 mg, 25%) and analog 200 (14.6 mg. 44%) as a yellow products.

Example 65. Synthesis of Analog 201

[6-(acetamidopropyl)acylfulvene]: To a solution of analog 195 (49.1 umol) and water (20 μL in THF (0.5 ml) was added a solution of O-acetyl-2-(diphenylphosphino)phenol (39.0 umol) in THF (0.5 mL). The mixture was stirred for 3 days at room temperature then concentrated. The crude product was chromatographed (100% ethyl acetate) to yield 8.2 mg of analog 201.

Example 66. Synthesis of Analog 202

(i.e., analog 211 linked to proline): Prepared via Staudinger ligation. To a solution of analog 195 (94 umol) in THF (1.2 mL), water (40 μL) was added, the was added N-Boc-proline, 2-(diphenylphosphino)phenyl ester (101 μmol) in THF (0.8 mL). The mixture was stirred for 3 days at room temperature then concentrated. The crude product was chromatographed (5:1→1:2 hexanes-ethyl acetate) to yield 31.4 mg (66.7 umol) of analog 202-Boc (71%). The analog 202-Boc was dissolved (66.7 umol) in dioxane (2.0 mL) and 2.0 mL of 2M $H_2SO_4$ was added, and the mixture was stirred overnight. Water and ethyl acetate was added, orange color appeared in the aqueous. The aqueous was extracted again with ethyl acetate and organic layer discarded. Sodium bicarbonate was added to aqueous until basic, re-extracted with ethyl acetate. The solution was dried with magnesium sulphate, concentrated to dryness, dissolved in $CH_2Cl_2$ and 8 mg of TFA added (1 drop). Analog 202 was obtained in an amount of 22.2 mg (69%).

Example 67. Synthesis of Analog 203

Synthesis of Analog 208 (9.2 mg, 16.5 umol) is dissolved in $CH_2Cl_2$ (1.5 mL), 1 drop of anisole added, then 0.5 mL of trifluoro acetic acid for 15 minutes. The mixture is concentrated, dissolved in water, then re-extracted with $CHCl_2$, and the orange color remains in the aqueous phase, which is concentrated to give analog 203 as the orange colored TFA salt (10.0 mg).

Example 68. Synthesis of Analog 204

Although the Fmoc-Pro-OH would preferentially react with the primary hydroxyl group on Illudin S, the resulting ester linkage is not stable, as illudin S was recovered after storage in $CDCl_3$ for several days at room temperature. The secondary hydroxy group of illudin S was therefore used for coupling with peptides. The primary hydroxy group of illudin S first protected with a TBS group (TBSCl, Imidazole, and DMF, 92%) to produce analog 204.

Example 69. Synthesis of Analog 205

Analog 309 (20 mg, 0.050 mmol, 1 equiv.), triphenylphosphine (40 mg, 0.1525 mmol, 3 equiv.) was dissolved in THF (1 mL) at room temperature. After 20 hours a few drops of water was added and the mixture was heated up at 70° C. After 5 hours the solution was cooled down and evaporated. The residue was chromatographed (hexane/EtOAc/Et₃N 4:1:0.1) to give analog 205 (5.3 mg, 29%) as an oil.

Example 70. Synthesis of Analog 206

Analog 205 (14 mg, 0.037 mmol, 1 equiv.) was dissolved in $CH_3CN$ (0.5 ml) and pyridine (0.1 ml) at 0° C. To this solution was added HF.Pyridine (7 μL, 0.245 mmol, 35 M, 6.6 equiv.). After 10 min $K_2CO_3$ (0.5 mL, 0.5 M) was added and this mixture was chromatographed ($CH_2Cl_2$/Methanol/Et₃N 5:0.5:0.1) to give analog 206 (10 mg, 68%) as an oil.

Example 71. Synthesis of Analog 207

(211-leucine): Prepared via Staudinger ligation. To a solution of analog 195 (101 umol) in THF (1.0 mL), water (40 μL) was added, then was added N-Boc-leucine,2-(diphenylphosphino)phenyl ester (95.9 μmol) in THF (1.2 mL). The mixture was stirred for 6 days at room temperature then concentrated. The crude product was chromatographed (1:1 hexanes-ethyl acetate) to yield 27.3 mg of analog 207-Boc. The analog 207-Boc was dissolved (16 μmol) in $CH_2Cl_2$ with 3 drops of anisole, TFA was added (0.3 mL), and the mixture was stirred for 15 minutes then concentrated. The crude material was dissolved in water then extracted with $CH_2Cl_2$. The aqueous layer was recovered and concentrated to yield 17.4 mg of the analog 207 TFA salt (87%).

Example 72. Analog 208

The TFA salt of analog 196 (13.7 mg, 28.2 μmol) was dissolved in anhydrous DMF (2.5 mL), Boc-Serine-OH (9.6 mg, 47 umol) was added, ODHBT (13.0 mg, 79.4 umol), cooled to 0° C. under a nitrogen atmosphere. Next EDC (15.1 mg) was added followed by NMM (10 μL) to adjust pH, and the mixture stirred at 0° C. for 3 hours. The reaction was added to ethyl acetate/water mixture, and the orange product appeared in the organic layer. The aqueous layer was re-extracted with ethyl acetate, organic layers combined, washed with dilute $NaHSO_4$, water, saturated $NaHCO_3$, brine, then dried with $MgSO_4$. The organic layer was concentrated then chromatographed (1:3 hexane:ethyl acetate) to yield analog 208 as an orange residue (63% yield).

Example 73. Synthesis of Analog 209

The TFA salt of analog 196 (12.5 mg, 25.7 μmol) was dissolved in anhydrous DMF (2.5 mL), Boc-Serine-Ser OH (88.6 umol) was added, ODHBT (33.9 mg, 205 umol), cooled to 0° C. under a nitrogen atmosphere. Next EDC (142 umol) was added followed by NMM (10 μL) to adjust pH, and the mixture stirred at 0° C. but allowed to gradually warm as the ice melts. The mixture was stirred a total of 16 hour then 1 mL water added followed by stirring for 50 minutes. The reaction was added to ethyl acetate/water mixture, and the orange product appeared in the organic layer. The aqueous layer was re-extracted with ethyl acetate, organic layers combined, washed with dilute $NaHSO_4$, water, saturated $NaHCO_3$, brine, and then dried with $MgSO_4$. The organic layer was concentrated then chromatographed (10:1 ethyl acetate:methanol) to give analog 209 as an orange residue (5.9 mg, 36% yield).

Example 74. Synthesis of Analog 210

(Ac-Hyp-Ser-Ser-Chg-Gin-Ser-Ser-Pro-O—(CH₂)₃-acylfulvene): To a mixture of Analog 1% TFA salt (21.6 umol), the peptide Ac-Hyp-Ser-Ser-Chg-Gln-Ser-Ser-OH (30.3 umol), ODHBt (3,4,-dihydroxy-4-oxo-1,2,3-benzo-triazine-3-yl ester, 71.7 μmol) and NMM (N-methylmorpholine; 7.5 ul) in DMF (2.0 ml) at room temperature is added EDC (1-(3-dimethylaminopropyl)-3-ethylcarbodiimide hydrochloride, 68 μmol), the mixture stirred for 2 hours at room temperature, then diluted with 10 mL of water. Solution is directly chromatographed on a reverse phase C18 column (4:1→2:1, water/acetonitrile gradient) to yield 69% of analog 210.

Example 75. Synthesis of Analog 212

(Illudin M-proline) Illudin M (20 mg, 0.081 mmol, 1 equivalent), DMAP (0 mg, 0.008 mmol, 0.1 equiv.) and Fmoc-Pro-OH (33 mg, 0.097 mmol, 1.2 equiv.) were dissolved in $CH_2Cl_2$ (mL) at 0° C., to which was added a $CH_2Cl_2$ solution of DCC (100 μL, 0.1 mmol, 1 M, 1.2 equiv.). The temperature of the mixture gradually rose to 5C in 1.5 hours and then the mixture was filtered through a pad of Celite. The filtrate was concentrated and the residue was chromatographed ($CH_2Cl_3$/EOAc 5:0.1-5:0.4) to give Illudin-M-proline-Fmoc protected analog (36 mg, 79%) as oil. The proton spectra of this oil showed that it was a mixture of two isomers (rotamers). And then this oil was dissolved in $CH_2Cl_2$ (4 mL) and treated with piperidine (I mL) at 0° C. After 0.5 hours the solution was concentrated and the concentrate was chromatographed ($CH_2Cl_2$/Methanol 5:0.4) to give analog 212 (15 mg, 54%) as oil.

Example 76. Synthesis of Analog 213

Analog 204 is coupled with Fmoc-Pro-H (DMAP, $CH_2Cl_2$, DCC, 0° C., 85%), followed by deprotection of Fmoc group with 20% piperidine in $CH_2Cl_2$ to produce analog 213 in 78% yield.

Example 77. Synthesis of Analog 214

(Illudin S-Pro-Ser-Ser-HHOAc): The Fmoc protected peptide of H-Ser-Ser-OH was prepared by taking H-Ser-Ser-OH (50 mg, 0.26 mmol, 1 equiv.) and $K_2CO_3$ (89.7 mg, 0.65 mmol, 2.5 equiv.), dissolving in a mixture of water (4 mL) and dioxane (3 mL) at 0° C. To this solution FmoCl (67.3 mg, 0.26 mmol, 1 equiv.) was added in several portions. After 18 hours the mixture was acidified by $KHSO_4$ and the pH raised to 2.5. Then this mixture was taken up by ethyl acetate, which was washed with brine, dried, filtered and evaporated. The residue was chromatographed ($CH_2Cl_2$/Methanol/HOAc 5:1:0.1) to give 3.27 (75 mg, 70%) as a white solid. The analog 212 (Illudin S tosylate-Pro) (42.8 mg 0.09 mmol, 0.9 equiv.), and the Fmoc protected H-Ser-Ser-OH peptide (41.2 mg, 0.1 mmol, 1 equiv.) were dissolved in DMF (1.5 mL) at 0° C. To this solution was added NMM (22 μL, 0.2 mmol, 2 equiv.), ODHBt (29.4 mg, 0.18 mmol, 1.8 equiv.), and EDC (31.1 mg, 0.16 mmol, 1.6 equiv.). The solution temperature was then raised to room temperature and kept for 3 hours before it was taken up by ethyl acetate. The mixture was then washed with saturated sodium bicarbonate and brine. It was then dried, filtered and evaporated. The residue was chromatographed ($CH_2Cl_3$/Methanol 5:0.3) to give analog 214 (50.5 mg, 67%) as an oil.

Example 78. Synthesis of Analog 215

(Illudin S-Pro-Ser-Ser-Gin-Chg-Ser-Ser-Hyp-Ac) Analog 204 is coupled with Fmoc-Pro-H (DMAP, $CH_2Cl_2$, DCC, 0° C., 85%), followed by deprotection of Fmoc group with 20% piperidine in $CH_2Cl_2$ to produce analog 213 in 78% yield. Peptide conjugate, analog 215 was obtained from further coupling with hepta-peptide Ac-Hyp-Ser-Ser-Chg-Gln-Ser-Ser-OH (ODHBt, NMM, DMF, 0° C., 47%).

Example 79. Synthesis of Analog 216

(Illudin M-Pro-Ser-Ser-Gln-Chg-Ser-Ser-Hyp-Ac). Analog 212 was further coupled with the commercially available hepta-peptide Ac-Hyp-Ser-Ser-Chg-Gin-Ser-Ser-OH (ODHBt, NMM, DMF, EDC, 0° C.) to yield analog 216 at 33%. The low yield resulted from repeated chromatographic purification as the purity of the final raw product was estimated by HPLC to be only 70%.

Example 8. Synthesis of Analog 217

To a solution of Irofulven (1.00 equivalent), epsilon-maleimidocaproic acid (1.27 equivalent), DMAP (0.15 equivalent) in 1.0 mL of methylene chloride ($CH_2Cl_2$) at 0° C., is added DCC (dicyclohexylcarbodiimide; 1.27 equivalent) in methylene chloride ($CH_2Cl_2$). The mixture is stirred for 1.25 hours, diluted with hexane and precipitated is filtered. Residual solvent is evaporated off, and oil residue is chromatographed on a silica column (2:1 hexanes:ethyl acetate) to yield analog 217, an orange compound (77% yield).

Example 81. Synthesis of Analog 218

To a solution of Illudin M (1.00 equivalent), epsilon-maleimidocaproic acid (1.33 equivalent), DMAP (0.18 equivalent) in 1.0 mL of methylene chloride ($CH_2Cl_2$) at 0° C., is added DCC (dicyclohexylcarbodiimide; 1.33 equivalent) in methylene chloride ($CH_2Cl_2$). The mixture is stirred for 2.25 hours, diluted with hexane and precipitated is filtered. Residual solvent is evaporated off and oil residue is chromatographed on a silica column (2:1 hexane:ethyl acetate) to yield analog 218, an orange compound (83% yield).

Example 82. Synthesis of Analog 219

Analog 204 (33.4 mg) is dissolved in 1.0 mL of anhydrous pyridine under a nitrogen atmosphere, then DMAP (5.1 mg) is added, followed by 4-fluorosulfonyl-benzoyl chloride (86.1 mg). The mixture is stirred for 90 minutes at room temperature. The mixture is diluted with ethyl acetate, washed once with saturated copper sulfate solution, washed twice with water, then dried over $MgSO_4$, concentrated then chromatographed (20% ethyl acetate:hexane) to give analog 219.

Example 83. Synthesis of Analog 221

Prepared from Analog 207 by coupling with Mu-His-Ser-Ser-Lys(Fmoc)-Leu-Gln-OH in DIC/HOBt for 5 minutes, then 5% piperidine/DMF for 1 minute. Followed by TFA quenching to yield analog 221 at 21% yield.

Example 84. Synthesis of Analog 222

Illudin M (63 mg) is dissolved in 1.0 mL of anhydrous pyridine under a nitrogen atmosphere, then DMAP (6.4 mg) is added, followed by 4-fluorosulfonyl-benzoyl chloride (86 mg). The mixture is stirred for 35 minutes at room temperature then chromatographed (20% ethyl acetate:hexane) to give analog (70.9 mg).

Example 85. Synthesis of Analog 223

The disulthydryl peptide CNGRC is first converted to a cyclic disulfide peptide by dissolving 355 mg in 3.0 mL DMSO, adding 9 mL of water, allowing to sit overnight at room temperature, followed by water removal on a rotoevaporator then DMSO removal under high vacuum. The TFA salt of analog 179 (14.5 mg) is dissolved in DMF (2.0 mL) and the CNGRC disulfide peptide added (19.0 mg), 60 µL of DIPEA is added, followed by gradual addition of a solution of Py-BOP (19.6 mg) and HOBt (8.9 mg) in DMF (2.0 mL) over 150 minutes at room temperature. The reaction is stopped by adding two drops of TFA and water. The mixture is applied to a reverse phase column and analog 223 is eluted with acetonitrile:water (1:4).

Example 86. Synthesis of Analog 224

Acylfulvene (116 mg) is dissolved in ethanol (4.0 mL) with stirring, hydroxylamine hydrochloride (84.2 mg) added, Sodium acetate (233 mg) added, then refluxed for 70 minutes at 85° C. The ethanol is removed, then ethyl acetate (10 mL) added to dissolve crude product, then water (10 mL) added, the organic layer is washed with brine, dried over $Na_2SO_4$, concentrated then chromatographed (20% ethyl acetate:hexane) to give analog 224 (63.7 mg, 54% yield).

Example 87. Synthesis of Analog 225

Illudin S (439 mg) is dissolved in ethanol (15 mL) with stirring, hydroxylamine hydrochloride (233 mg) added, sodium acetate (933 mg) added, then refluxed for 130 minutes at 85° C. The solution is cooled to room temperature, filtered, ethanol is removed, then ethyl acetate (30 mL) added to dissolve crude product, then water (30 mL) added, the organic layer is washed with brine, dried over $Na_2SO_4$, concentrated then chromatographed (30%→50%, acetone:hexane) to give analog 225 (372 mg, 80% yield).

Example 88. Synthesis of Analog 226

Irofulven (37.6 mg) is dissolved with stirring in $CH_2Cl_2$, elaidic acid (180 mg. 1.3 equivalents) added, DMAP (15 mg) added, cooled to 0° C., then DCC (180 µL) in $CH_2Cl_2$ (640 µL) added. Reaction mixture stirred at 0° C. for 1 hour, then additional DCC (120 µL) added, and stirred for 2 more hours. Mixture chromatographed (20% ethyl acetate:hexane) to give analog 226 as a yellow oil (50.5 mg, 48% yield).

Example 89. Synthesis of Analog 227

Analog 009 (87 mg) is dissolved with stirring in $CH_2Cl_2$, elaidic acid (108 mg) added, DMAP (15.4 mg) added, cooled to 0° C., then DCC (0.5 mL) in $CH_2Cl_2$ (1.5 mL) added. Reaction mixture stirred at 0° C. for 3 hours, then the mixture directly chromatographed (20% ethyl acetate:hexane) to give analog 227 as a yellow oil (105 mg, 61% yield).

Example 90. Synthesis of Analog 228

Illudin S (86 mg) is dissolved with stirring in $CH_2Cl_2$, elaidic acid (202 mg) added, DMAP (15.4 mg) added, cooled to 0° C., then DCC (1.0 mL) in $CH_2Cl_2$ (3.0 mL) added. Reaction mixture stirred at 0° C. for 3 hours, then the mixture directly chromatographed (20% ethyl acetate:hexane) to give analog 228 as a yellow oil (198 mg, 77% yield).

Example 91. Synthesis of Analog 229

The elaidic ester of 0-diphenylphosphine phenol is first prepared by dissolving with stirring in 3.0 mL of $CH_2Cl_2$ the O-diphenylphosphine phenol (91.3 mg), elaidic acid (94.5 mg, 1 equivalent), DMAP (9.4 mg). The solution is cooled to 0° C. then DDC (0.44 mL, 1.0 M in $CH_2Cl_2$) is added with stirring for 3.5 hours. The precipitate is filtered off and discarded. The elaidic ester is chromatographed and concentrated to dryness then dissolved in THF (1.0 mL). Analog 195 (26.1 mg) is dissolved in THF (1.0 mL) and water (80 µL) added. The elaidic ester solution is slowly added to the analog 195 solution with stirring, and reacted for 22 hours at room temperature. The mixture is directly chromatographed (30% acetone:hexane) to give analog 229 (22.2 mg, 47% yield).

Example 92. Synthesis of Analog 230

Analog 308 (22 mg) is dissolved in anhydrous $CH_2Cl_2$ (1.5 mL), diisopropylethylamine (20 µL) added, and the mixture cooled to 0° C., then methylsulfonyl chloride added (15 µL), mixture stirred at 0° C. for 1 hour, and allowed to warm to room temperature while being stirred for an additional hour. The mixture is chromatographed (30% ethyl acetate in hexane) to yield analog 230 (35% yield).

Example 93. Synthesis of Analog 231

Analog 308 (16 mg) is dissolved in anhydrous $CH_2Cl_2$ (1.5 ml), diisopropylethylamine (20 µL) added, and the mixture cooled to 0° C., then tosyl chloride added (18.4 mg), mixture stirred at 0° C. for 1 hour, and allowed to warm to room temperature while being stirred for an additional 3 hours. The mixture is chromatographed (30% ethyl acetate in hexane) to yield analog 231 (8.6 mg).

Example 94. Synthesis of Analog 240

Analog 232 (25.1 mg) is dissolved in anhydrous $CH_2Cl_2$ (2.0 ml), 15 µL of acetic anhydride added, and the mixture cooled to room temperature, then DMAP added (5 mg), and stirred for 25 minutes. The mixture is partially concentrated then chromatographed (30% ethyl acetate in hexane) to yield analog 240 (26.6 mg, 93% yield).

Example 95. Synthesis of Analog 254

Analog 009 (51.4 mg), 4-carboxybenzene sulfonamide (59.4 mg), and DCC (39.6 mg) were dissolved in anhydrous DMF (1.0 mL) at room temperature, stirred, then DMAP (15 mg) added. The mixture was stirred for 2 hours at mom temperature then solid material was filtered off. The mixture was then chromatographed (1:1 ethyl acetate:hexane) to give analog 254 (38.6 mg, 45% yield).

Example 96. Synthesis of Analog 255

Analog 009 (244.3 mg) and sulfamoyl chloride (157 mg) were dissolved in anhydrous DMAP (2.0 mL) at room temperature, and stirred for 3.5 hours. The mixture was concentrated under high vacuum then chromatographed (30% ethyl acetate in hexane) to give analog 255.

Example 97. Synthesis of Analog 259

Analog 255 (64.7 mg), (diacetoxyiodo)benzene (64.7 mg), dirhodiumtetracetate or $Rh_2(OAc)_4$ and magnesium (16.8) dissolved in 5.0 mL of $CH_2Cl_2$ are heated to 70° C. and stirred for 7 hours. The mixture is filtered, concentrated, then chromatographed (1:1 ethyl acetate:hexane) to give analog 259.

Example 98. Synthesis of Analog 262 and 263 (Prepared Together)

Analog 25 (44.7 mg) is dissolved in methanol (1.0 mL), Oxone® reagent (246 mg, 3 equivalents) is dissolved in water (1.0 mL). The oxone solution is slowly added to the methanol solution with stirring at room temperature for 3.5 hours, then an additional amount of Oxone reagent added followed by stirring for 1.5 hours. Then 2 mL of saturated sodium sulfite solution was added, followed by ethyl acetate extraction, dried over $Na_2SO_4$, concentrated then chromatographed (1:1 Ethyl acetate:hexane) to yield first analog 263 (21.4 mg) and then analog 262 (14.3 mg).

Example 99. Synthesis of Analog 284 and 289 (Prepared Together)

Analog 34 (174 mg) and uracil (227 mg) are dissolved in $CH_2Cl_2$ with stirring and the mixture cooled to 0° C. Then $SnCL_4$ (148.8 ILL) is slowly added. The mixture is stirred at 0° C. for 80 minutes, then concentrated, chromatographed (2→5% methanol:$CH_2Cl_2$) to give analog 284 (68.9 mg, 33% yield) and analog 289 (21.6 mg, 10% yield).

Example 100. Synthesis of Analog 285

Analog 34 (25 mg) is dissolved in ethanol, and O-(tert-Butyldimethylsilyl) hydroxylamine (25 mg) is added followed by stirring for 2 hours at room temperature. The secondary amine intermediate (9 mg) is recovered by chromatography (30% ethyl acetate:hexane), dissolved in $CH_2Cl_2$, and reacted with sulfamoil chloride ($ClSO_2NH_2$, 5 mg) and DABCO (2 mg) with stirring for one hour, then additional sulfamoil chloride (6 mg) was added with stirring for another 1.5 hours. The TPS blocked product was recovered by chromatography (30% ethyl acetate:hexane), and the TPS group was removed in THF by adding TBAF (Tetra-n-butylammonium fluoride). The TPS group can also be removed by dissolving the TPS product in pyridine and THF at 0° C., then adding HF-pyridine overnight. After TPS deblocking the mixture is chromatographed (50% ethyl acetate:hexane) to give analog 285.

Example 101. Synthesis of Analog 236 and 287 (Prepared Together)

The ketone groups on 5-fluorouracil are first blocked with TMS groups by dissolving 5-fluorouracil (610 mg) and $(NH_4)_2SO_4$ in HMDS (10 mL) under a nitrogen atmosphere. The solution is refluxed at 142° C. for 2.5 hours, cooled to 60° C. and excess HMDS distilled off, then concentrated to dryness under high vacuum. Analog 34 (180 mg) and the di-TMS 5-fluorouracil are dissolved in $CH_2Cl_2$ (5.0 mL) with stirring and the mixture cooled to 0° C. Then $SnCL_4$ (120 µL) is slowly added drop wise. The mixture is stirred at 0° C. for 3.5 hours, then concentrated, chromatographed (80% ethyl acetate:hexane) to give analog 286 (18.9 mg. 9% yield) and analog 287 (84 mg, 38% yield).

Example 102. Synthesis of Analog 289

See the preparation of analog 284 for the preparation of analog 289 (284 and 289 prepared simultaneously then separated by chromatography).

Example 103. Analogs 299 and 300 (Prepared Together)

Analogs 299 and 300 are prepared in equal amounts from Illudin S using the Mitsunobu reaction. Illudin S is directly reacted with $HN_3(PPh_3$, DEAD, benzene) at O° C. under nitrogen for 45 minutes. Mitsunobu, O. *Synthesis* 1:1-28, 1981.

Example 104. Synthesis of Analog 301

Irofulven (31.6 mg, 0.128 mmol), 5-benzoylvaleric acid (35.8 mg, 0.174 mmol) and DMAP (4.7 mg) is dissolved in $CH_2Cl_2$ (2 mL) under a nitrogen atmosphere, cooled to 0° C., the DCC added (170 µL of LOM solution in $CH_2Cl_2$). The mixture is stirred for 60 minutes then diluted with hexane (10 mL) and filtered. The organic layer is further diluted with $CH_2Cl_2$, washed with water, then saturated $NaHCO_3$ then brine, dried with $MgSO_4$, concentrated, then dissolved in $CH_2Cl_2$, filtered and chromatographed (10:3 hexane:ethyl acetate), appropriate fractions collected, pooled, concentrated then chromatographed (3:1 hexane:ethyl acetate) to give analog 301 (23.2 mg, 42% yield).

Example 105. Analogs 302 and 303 (Prepared Together)

Illudin S (100 mg. 0.378 mmol) is benzoylated by dissolving in pyridine (1.0 mL) then adding 3, 5-dintirobenzoyl chloride (110 mg, 0.5 mmol) at room temperature and stirring for 24 hours. The mixture is poured onto crushed ice then extracted with $CH_2Cl_2$ (10 mL), which is washed twice with water (20 mL). The organic layer is dried over $Na_2SO_4$ and concentrated to yield analogs 302 and 303. The two analogs can be separated by column chromatography (1:1 hexane:ethyl acetate).

Example 106. Synthesis of Analog 304

Analog 009 (84.6 mg) is dissolved in anhydrous $CH_2Cl_2$ (3.0 mL), DCC added (81.2 mg), mixture cooled to 0° C., propiolic acid (35 µL) added, then the reaction started with DMAP (15 mg), stirred and allowed to warm to room temperature over 1 hour. The mixture was filtered to remove solids then chromatographed (30% ethyl acetate in hexane) to give analog 304 (60% yield).

Example 107. Synthesis of Analog 305

Analog 009 (99.1 mg) is dissolved in anhydrous $CH_2Cl_2$ (3.0 mL), pyridine (150 µL) added, then p-nitrophenylchloroformate added and stirred for 3.5 hours at room temperature. The mixture was concentrated, hexane (20 mL) added, and precipitate filtered before chromatographing (50% ethyl acetate in hexane) to give analog 305 (50% yield).

Example 108. Synthesis of Analog 306

Analog 009 (244 mg) is dissolved in anhydrous $CH_2Cl_2$ (4.0 mL), tosyl chloride (181 mg) added, the mixture cooled to 0° C., to which an aliquot of pyridine (80 µL) is added. The mixture stirred at 0° C. for 1 hour, and allowed to warm to room temperature while being stirred for an additional 20 hours. The mixture is concentrated then chromatographed (50% ethyl acetate in hexane) to yield analog 306.

Example 109. Synthesis of Analog 307

A solution of 1.0 M $N_3H$ in benzene is first prepared by mixing 654 mg NAH, 0.65 mL water, in 10 mL of benzene.

The mixture is cooled to OC, 0.5 mL of concentrated $H_2SO_4$ added, and allowed to warm slowly to room temperature and then stirred for 80 minutes. Next $PPh_3$ (590 mg) is dissolved in anhydrous THF (1.5 mL) and cooled to 0° C. Then 2.1 mL of N3H 1.0 M solution is added, followed by DEAD (0.475 mL) then Illudin S (282 mg in 1.0 mL anhydrous THF). The mixture is stirred for 3 hours at 0° C., warmed, concentrated, followed by chromatography (30% ethyl acetate in hexane) to give analog 307.

Example 110 Synthesis of Analog 308

Analog 307 (100 mg) is dissolved in anhydrous THE (3.0 mL) at room temperature and PPH3 added (306 mg, 3 equivalents). The mixture is stirred for 5 hours at room temperature, then the reaction stooped by adding water (0.15 mL). The mixture is heated to 85° C. for 30 minutes, then concentrated and chromatographed (20% methanol in ethyl acetate) to give analog 308.

Example 111. Synthesis of Analog 309

Analog 204 was reacted with $HN_3$ (DEAD, THF) to yield the wide analog 309 at 68% yield.

Example 112. Synthesis of Analog 310

Irofulven (42.9 mg), 4-carboxybenzene sulfonamide (41.4 mg), and DCC (38.4 mg) were dissolved in anhydrous DMF (1.0 mL) at room temperature, stirred and then DMAP (10 mg) added. The mixture was stirred for 75 minutes at room temperature then solid material was filtered off. The mixture was then chromatographed (1:1 ethyl acetate: hexane) to give analog 310 (40% yield).

Example 113. Synthesis of Analog 311

Illudin M (32.4 mg), 4-carboxybenzene sulfonamide (39.7 mg), and DCC (24.4 mg) were dissolved in anhydrous DMF (1.0 mL) at room temperature, stirred, then DMAP (15 mg) added. The mixture was stirred for 75 minutes at room temperature, allowed to warm to room temperature, then stirred for 22 hours. The solid material was filtered off and the mixture was then chromatographed (1:1 ethyl acetate: hexane) to give analog 311 (35% yield).

Example 114. Synthesis of Analog 312

Irofulven (1.18 grams) is dissolved in anhydrous $CH_2Cl_2$ (4.0 mL), tosyl chloride (1.1 equivalent) added, the mixture cooled to 0° C., then pyridine (0.4 mL) added. The mixture stirred at 0° C. for 1 hour, and allowed to warm to room temperature while being stirred for an additional 3 hours. The mixture is concentrated then chromatographed (50% ethyl acetate in hexane) to yield analog 312.

Example 115. Synthesis of Analog 313

Analog 308 (31 mg) is dissolved in anhydrous $CH_2Cl_2$, cooled to 0° C., with stirring then diisopropylethylamine added (45 µL), then fluorophenylsulfonyl chloride added (36 µL) for 3 hours at 0° C. Mixture is directly chromatographed (20% ethyl acetate:hexane) to give analog 313 (23.3 mg).

Example 116. Synthesis of Analog 314

Analog 009 is dissolved in anhydrous $CH_2Cl_2$ (4.0 mL), tosyl chloride (1.1 equivalent) added, the mixture cooled to 0° C., then pyridine (0.4 mL) added. The mixture stirred at 0° C. for 1 hour, and allowed to warm to room temperature while being stirred for an additional 3 hours. The mixture is concentrated then chromatographed (50% ethyl acetate in hexane) to yield analog 314.

Example 117. Synthesis of Analog 315

Irofulven was dissolved in a solution of 2,5 dimethylpyrrole (4 fold excess molar solution) in 5 mL of dry $CH_2Cl_2$ at −78° C. Boron trifluoride (equivalent molar amount to the irofulven) was slowly added with stirring. The reaction was allowed to stir for 2 more hours at −78° C., then water slowly added. The mixture was extracted twice with 2 fold equivalent volumes of ethyl acetate, the organic extracts combined, washed with saturated $NaHCO_3$, water, brine, then dried over $MgSO_4$. The solution was concentrated under vacuum until a red residue remained, which was chromatographed on silica gel (50% ethyl acetate in hexane) to yield analog 315 (30% yield).

Example 118. Synthesis of Analog 316

Analog 316 was prepared by dissolving Illudin S (20 mg) in pyridine (0.5 mL) and then 4-fluorosulfonylbenzoyl chloride (equivalent molar amount) was added to the mixture in an ice bath. The solution is allowed to warm slowly and then react overnight. The liquid was then removed under reduced pressure until a crude residue remained. Rather than recrystallize from chloroform, the residue was instead chromatographed on a standard silica gel column using hexane-ethylacetate (1:1). The mono-adduct (analog 316), a di-adduct and a small amount of unreacted Illudin S were recovered in separate eluates.

Example 119. $N_3H$ 1.0 M Solution

A solution of 1.0 M N3H in benzene is first prepared by mixing 654 mg $N_3H$, 0.65 mL water, in 10 mL of benzene. The mixture is cooled to 0° C., 0.5 mL of concentrated $H_2SO_4$ added, and allowed to warm slowly to room temperature and then stirred for 80 minutes.

Example 120. Synthesis of Analog 193

Irofulven (221 mg, 0.897 umol) is dissolved in anhydrous THF (1.5 mL), then $PPh_s$(261 mg, 0.995 umol) is added, then 1.0 M $N_3H$ solution (1.0 mL, 1.0 mmol) under nitrogen atmosphere. The solution is cooled to −40° C., ad then DIAD (0.21 mL, 1.013 umol) added and stirred for 30 minutes at 0° C. then diluted with hexane, and filtered to remove precipitate. The mixture is concentrated then chromatographed (30% ethyl acetate:hexane) to give analog 193 (171 mg, 71%).

Example 121 Synthesis of Analog 195

Analog 009 (31.9 mg, 116 umol) is dissolved in anhydrous THF (3.0 mL), then $PPh_3$ (33 mg, 126 umol) is added, then 1.0 M $N_3H$ solution (0.3061 mL) under nitrogen atmosphere. The solution is cooled to 0° C., DIAD (30 µL, 145 umol) added and stirred for 30 minutes at 0° C. then water (5 µL) is added to destroy the $PPh_3$. The mixture is concentrated then chromatographed (30% ethyl acetate: hexane) to give analog 195 (24.9 mg, 72%).

The foregoing description of embodiments of the methods, systems, and components of the present invention has been provided for the purposes of illustration and description. It is not intended to be exhaustive or to limit the invention to the precise forms disclosed. Many modifications and variations will be apparent to one of ordinary skill in the relevant arts. For example, steps performed in the embodiments of the invention disclosed can be performed in alternate orders, certain steps can be omitted, and additional steps can be added. The embodiments were chosen and described in order to best explain the principles of the invention and its practical application, thereby enabling others skilled in the art to understand the invention for various embodiments and with various modifications that are suited to the particular used contemplated. Other embodiments are possible and are covered by the invention. Such embodiments will be apparent to persons skilled in the relevant art(s) based on the teachings contained herein. The breadth and scope of the present invention should not be limited by any of the above-described exemplary embodiments, but should be defined only in accordance with the following claims and their equivalents.

Table IA shows acylfulvene amine analogs which can be attached to a bi-functional linker which can then be attached to a sulfhydryl reacting group of the AM using the reagent.

| Amine analog | Reagent |
| --- | --- |
| 97 121, 176, 179, 184, 203, 205, 206, 207, 211, 220, 244, 245, 254, 255, 264, 266, 267, 270, 276, 283, 285, 294, 295, 296, 297, 308, 310, 311 | 2IT [2-iminothiolane (generated from) methyl 4-mercaptobutyrimidate], AMAS [N-(α-maleimidoacetoxy)-succinimide ester], BMPA [N-β-malemidopropionic acid], BMPS [N-β-malemidopropyloxy)succinimide ester], C6-SFB [C6-succinimidyl 4-formylbenzoate], Citiolone [N-acetylhomocysteinethiolactone], DST [disuccinimidyl tartrate], EMCH [N-(episilon-maleimidocaproic acid) hydrazide], EMCS [N-(episilon-maleimideocaproyloxy)succinimide ester], GMBS [N-(gamma-maleimideobutyrloxy)succinimide ester], KMUA [N-kappa-maleimidoundecanoic acid], KMUH [N-(kappa-maleimidoundecanoic acid) hydrazide], LC-SMCC [succinimidyl 4-(N-maleimidomethyl)cyclohexane-1-carboxy-(6-amidocaproate)], LC-SDPD [succinimidyl 6-(3'-(2-pyridyl-dithio)propionamido)hexanoate], MBS [m-maleimidobenzoyl-N-hydroxysuccinimide ester], MCP [methyl 3-mercaptopropionimidate], MPBH [4-(4-N-maleimidophenyl)-butyric acid hydrazide], M2C2H [4-(N-maleimidomethyl)cyclohexanee-1-1carboxyl-hydrazide], NPIA [p-nitrophenyl iodoacetate], PDPH [3-(2-pyridyldithio)propionyl hydrazide], PDTP [3-2(pyridyldithio)propionate], PMPI [N-(p-maleimidophenyl)isocyanate], SATA [succinimidyl S-acetylthioacetate], SATP [succinimidyl acetylthiopropionate], SFB [succinimidyl p-formylbenzoate], SFPA [succinimidyl p-formylphneoxyacetate], SHTH [succinimidyl 4-hydrazidoterephthalate], SIAB [N-succinimidyl(4-iodoacetyl)-aminobenzoate], SIAC [succinimidyl 4-(((iodoacetyl)amino)methyl)-cyclohexane-1-caroxylate], SIACX [succinimidyl 6-(((( 4(iodoacetyl)amino)methyl) cyclohexane-1-carbonyl)aminohexanoate], SIAX [succinimidyl 6-((iodoacetyl)amino)hexanoate], SIAXX [succinimidyl 6-(6-(((iodoacetyl)amino)-hexanoyl)aminohexanoate], SAMSA [S-acetylmercaptosuccinic anhydride], SMCC [succinimidyl 4-(N-maleimidomethyl)-cyclohexane-1-carboxylate], SM(PEG)2 [NHS-PEO2-maleimide or maleimide PEG2 N-hydroxysuccinimide], SM(PEG)4 [NHS-PEO4-maleimide or maleimide PEG4 N-hydroxysuccinimide], SM(PEG)8 [NHS-PEO8-maleimide or maleimide PEG6 N-hydroxysuccinimide], SM(PEG)12 [NHS-PEO12-mleimide or maleimide PEG8 N-hydroxysuccinimide], SMPB [succinimidyl 4-(para-maleimido-phenyl)butyrate], SMPH [succinimidyl-6-(beta-maleimidopropionamido)hexanoate], SMPT [4-succinimidyloxycarbonyl-methyl-alpha-(2-pyridyldithio)toluene], SPDP [N-succinimidyl 3-(2-pyridyldithio)propionate], Sulfo-DST [sulfo-disuccinimidyl tartrate], Sulfo-EMCS N-(episilon-maleimidocaproyloxy)sulfosuccinimide], Sulfo-GMBS [N-(gamma-maleimidobutyrloxy)sulfosuccinimide ester], Sulfo-KMUS [N-(kappa-maleimidoundecanoyloxy)sulfosuccinimide ester], Sulfo-LC-SMPT [sulfosuccinimidyl 6-(alpha-methyl-alpha-(2-[pyridyldithio)-toluamido)hexanoate], Sulfo-LC-SPDP [sulfosuccinimidyl 6-(3'-(2-pyridyl-dithio)propionamido)hexanoate], Sulfo-MBS [m-maleimidobenzoyl-N-hydroxysulfosuccinimide ester], Sulfo-SIAB [sulfo-succinimidyl(4-iodoacetyl)-aminobenzoate], Sulfo-SMCC [sulfosuccimidyl 4-(N-maleimido-methyl)cyclohexane-1-carboxylate], Sulfo-SMPB [sulfosuccimidyl 4-(p-maleimidophenyl)butyrate] |

TABLE 1B

Acylfulvene amine analogs attached to a linker which is attached to a photoactivatable group at the other terminus.

| Amine analog | Reagent |
| --- | --- |
| 97, 121, 176, 179, 184, 203, 205, 206, 207, 211, 220, 244, 245, 254, 255, 264, 266, 267, 270, 276, 283, | ANB-NOS [N-5-azido-2-nitrobenzyloxy-succinimide], NHS-ASA [N-hydroxysuccinimidyl-4-azidosalicylic acid], SADPH [N-succinimidyl (4'-azidophenyl)1,3'-dithiopropionate], SANPAH [N-succinimidyl 6-(4'azido-2'-nitrophenylamino)hexanoate], SPB [succinimidyl-(4-psoralen-8y;oxy)butyrate], Sulfo-HSAB [N-hydroxysulfosuccinimidyl-4-azidobenzoate], Sulfo-NHS-LC-ASA [sulfosuccinimidyl(4-azido-salicylamido)hexanoate], Sulfo-SADP [sulfosuccinimidyl(4-azido- |

TABLE 1B-continued

Acylfulvene amine analogs attached to a linker which is attached to a photoactivatable group at the other terminus.

| Amine analog | Reagent |
|---|---|
| 285, 294, 295, 296, 297, 308, 310, 311 | phenyldithio)propionate], Sulfo-SAED [sulfosuccinimidyl 2-(7-azido-4-methylcoumarin-3-acetamido)ethyl-1,3'-dithiopropionate], Sulfo-SASD [sulfosuccinimidyl 2-(p-azido-salicylamido)ethyl 1,3'-dithiopropionate], Sulfo-SFAD [sulfosuccinimidyl(perfluoroazidobenzamido)ethyl 1,3'-dithiopropionate], Sulfo-SAND [sulfosuccinimidyl-2-(m-azido-o-nitrobenzamido)ethyl 1,3'-dithiopropionate], Sulfo-SANPAH [sulfosuccinimidyl 6-(4'-azido-2'-nitrophenylamino)hexanoate] |

TABLE IC

Acylfulvene amine analogs attached to a linker which is attached to an amine reactive group at the other terminus.

| Amine analog | Reagent |
|---|---|
| 97, 121, 176, 179, 184, 203, 205, 206, 207, 211, 220, 244, 245, 254, 255, 264, 266, 267, 270, 276, 283, 285, 294, 295, 296, 297, 308, 310, 311 | BS2G-do [bis(sulfosuccinimidyl)glutarate-d0], BS2G-d4 [bis(sulfosuccinimidyl)2,2,4,4,glutarate-d4], BS3 (or Sulfo-DSS) [bis(sulfosuccinimidyl)suberate], BS3do [bis(sulfosuccinimidyl)suberate], BS3d4 [bis(sulfosuccinimidyl)2,2,7,7-suberate-d4], BS(PEG)5 [bis(NHS) PEO5], BSOCOES [bis(2-(succininidoxycarbonyloxy)ethyl)sulfone], DMA [dimethyl adipimidate], DMP [dimethyl pimelimidate], DMS [dimethyl suberimidate], DFDNB [1,5,-difluoro-2,4-dinitrobenzene], DFDNPS [4,4'-difluoro-3,3'-dinitrophenylsulfone], DSG [disuccinimidyl glutarate], DSS [disuccinimidyl suberate], DST [disuccinimidyl tartarate], DSP or Lomant's reagent [dithiobis(succimidylpropionate)], DTBP dimethyl 3,3'-dithiobispropionimidate], DTSSP (sulfo-DSP) = [3,3'-dithio-bis(sulfosuccinimidylpropionate)], EGS [ethylene glycol bis(succinimidylsuccinate)], PMPI [N-(4-Isocyanatophenyl)maleimide], Sulfo-EGS [ethylene glycol bis(sulfo-succinimidyl-succinate)] |

TABLE ID

Acylfulvene amine analogs attached to a linker which is attached to a reactive group capable of reacting with an aldehyde, carbonyl or carboxylate group at the other terminus.

| Amine analog | Reagent |
|---|---|
| 97, 121, 176, 179, 184, 203, 205, 206, 207, 211, 220, 244, 245, 254, 255, 264, 266, 267, 270, 276, 283, 285, 294, 295, 296, 297, 308, 310, 311 | C6-SANH [C6-succinimidyl 4-hydraznonicotinate acetone hydrazone] SANH [succinimidyl 4-hydraznonicotinate acetone hydrazone] EDC [1-ethyl-3-(3-dimethylaminopropyl) carbodiimide hydrochloride] |

Table IIA shows acylfulvene carboxylate analogs which can be attached to a bi-functional linker which can be attached to a sulfhydryl reacting group of the AM.

| Carboxylate analog | Reagent |
|---|---|
| 29, 37, 38, 64, 97, 98, 106, 117, 118, 145, 160, 162, 177, 178, 181, 258 | BMPH [N-β-maleimidopropionic acid) hydrazide-trifluoroacetic acid salt], EMCH [N-(episilon-maleimidocaproic acid) hydrazide] KMUH [N-(kappa-maleimidoundecanoic acid)hydrazide], MPBH [4-(4-N-maleimidophenyl)-butyric acid hydrazide], PDPH [3-(2-pyridyldithio)propionylhydrazide], SHTH [succinimidyl 4-hydrazidoterephthalate], M2C2H [4-(N-maleimidomethyl) cyclohexanee-1-1carboxyl-hydrazide], PMPI [N-(4-Isocyanato-phenyl)maleimide], AMBH [2-acetamido-4-mercaptobutyric acid hydrazide] |

Table IIB shows acylfulvene carboxylate analogs which can be attached to a bi-functional linker, where the linker also contains a photoactivatable reactive group which can attach to the AM.

| Carboxylate analog | Reagent |
|---|---|
| 29, 37, 38, 64, 97, 98, 106, 117, 118, 145, 160, 162, 177, 178, 181, 258 | ABH [p-azidobenzoyl hydrazide] ASBA [4-(p-azidosalicylamido)-butylamine] |

Table IIC shows acylfulvene carboxylate analogs which can be attached to a bi-functional linker, where the linker also contains an amino reactive group which can attach to the AM.

| Carboxylate analog | Reagent |
|---|---|
| 29, 37, 38, 64, 97, 98, 106, 117, 118, 145, 160, 162, 177, 178, 181, 258 | EDC [1-ethyl-3-(3-dimethylamino-propyl) carbodiimide hydrochloride CMC [1-cyclohexyl-3-2(2-morpholinoethyl)carbodiimide] AADH [adipic acid dihydrazide] Woodward's Reagent K [N-ethyl-3-phen ylisoxazolium-3' sulfonate] |

TABLE IID

Acylfulvene carboxylate analog attached through carboxylate group to a linker where the linker also contains an azlactone reactive group to attach to the AM.

| Carboxylate analog | Reagent |
|---|---|
| 29, 37, 38, 64, 97, 98, 106, 117, 118, 145, 160, 162, 177, 178, 181, 258 | glycine or either an L or D amino acid including alanine, serine, threonine, cysteine, valine, leucine, isoleucine, methionine, proline, phenylalanine, tyrosine, tryptophan, aspartic acid, glutamic acid, asparagine, glutamine, histidine, lysine, arginine, or nonstandard amino acids including homocysteine, selenocysteine, pyrrolysine, carnitine, hypusine, lanthionine, 2-aminoisobutyric acid, dehydroalanine, gamma-aminobutyric acid, ornithine, citrulline, α-Amino-n-butyric acid, Norvaline, Norleucine, Pipecolic acid, Alloisoleucine, α,β-diaminopropionic acid, α,γ-diaminobutyric acid, Allothreonine, α-Amino-n-heptanoic acid, Homoserine, β-Amino-n-butyric acid, β-Aminoisobutyric acid, γ-Aminobutyric acid, isovaline, Sarcosine, N-ethyl glycine, N-propyl glycine, N-isopropyl glycine, N-methyl alanine, N-ethyl alanine, N-methyl β-alanine, N-ethyl β-alanine, Isoserine, α-hydroxy-γ-aminobutyric acid, diaminopimelic acid, cystathione, aminoisobutyric acid, dehydroalanine, delta-aminolevulinic acid, 4-aminobenzoic acid, Hydroxyproline, Formylmethioinine, lanthionine, djenkolic acid, Pyroglutamic acid, Hypusine, carboxyglutamic acid, penicillamine, thialysine, quisqualic acid, canavine, azeticline-2-carboxylic acid, 2-dimethylglycine. |

Table IIIA shows acylfulvene carbonyl analogs which can be attached to a bi-functional linker which can be attached to a sulfhydryl reacting group of the AM using the reagent.

| Carbonyl analog | Reagent |
|---|---|
| 13, 27, 28, 51, 83, 84, 124, 131, 144, 167, 184, 201, 207, 232, 233, 234, 235, 237, 238, 239, 240, 243, 276, 277, 278, 279, 280, 281, 282, 286, 287, 288, 289, 294, 295, 296, 297, 298, 301, 302, 303, | AMBH [2-acetamido-4-mercaptobutyric acid hydrazide, BMPH [N-β-maleimidopropionic acid) hydrazide-trifluoroacetic acid salt], EMCH [N-(episilon-maleimidocaproic acid) hydrazide], KMUH [N-(kappa-maleimidoundecanoic acid)hydrazide], MPBH [4-(4-N-maleimidophenyl)-butyric acid hydrazide], PDPH [3-(2-pyridyldithio)propionylhydrazide], SHTH [succinimidyl 4-hydrazidoterephthalate] |

Table IIIB shows acylfulvene carbonyl analogs which can be attached to a bi-functional tinker, where linker also contains photoactivatable reactive group which can attach to AM using reagent.

| Carbonyl analog | Reagent |
|---|---|
| 13, 27, 28, 51, 83, 84, 124, 131, 144, 167, 184, 201, 207, 232, 233, 234, 235, 237, 238, 239, 240, 243, 276, 277, 278, 279, 280, 281, 282, 286, 287, 288, 289, 294, 295, 296, 297, 298, 301, 302, 303 | ABH [p-azidobenzoyl hydrazide] ASBA [4-(p-azidosalicylamido)-butylamine] |

Table IIIC shows acylfulvene carbonyl analogs which can be attached to a bi-functional linker, where linker also contains an amine reactive group which can attach to the AM using the reagent.

| Carbonyl analog | Reagent |
|---|---|
| 13, 27, 28, 51, 83, 84, 124, 131, 144, 167, 184, 201, 207, 232, 233, 234, 235, 237, 238, 239, 240, 243, 276, 277, 278, | EDC [1-ethyl-3-(3-dimethylaminopropyl) carbodiimide hydrochloride CMC [1-cyclohexyl-3-2(2-morpholinoethyl)carbodiimide] |
| 279, 280, 281, 282, 286, 287, 288, 289, 294, 295, 296, 297, 298, 301, 302, 303 | C6-SANH [C6-succinimidyl 4-hydraznonicotinate acetone hydrazone] SANH [succinimidyl 4-hydraznonicotinate acetone hydrazone] |

Table IVA shows acylfulvene aldehyde analogs which can be attached to a bi-functional linker which can be attached to a sulfhydryl reacting group of the AM using the reagent.

| Aldehyde analog | Reagent |
|---|---|
| 8, 10, 11, 13, 41, 144, 156, 201 | BMPH [N-β-maleimidopropionic acid) hydrazide-trifluoroacetic acid salt], EMCH [N-(episilon-maleimidocaproic acid) hydrazide], KMUH [N-(kappa-maleimidoundecanoic acid)hydrazide], MPBH [4-(4-N-maleimidophenyl)-butyric acid hydrazide], PDPH [3-(2-pyridyldithio)propionylhydrazide], SHTH [succinimidyl 4-hydrazidoterephthalate], AMBH [2-acetamido-4-mercaptobutyric acid hydrazide], PMPI [N-(4-Isocyanatophenyl)maleimide], AMBH [2-acetamido-4-mercaptobutyric acid hydrazide] |

Table IVB shows acylfulvene aldehyde analogs which can be attached to a bi-functional mixer, where the linker also contains a photoactivatable reactive group which can attach to the AM using the reagent.

| Aldehyde analog | Reagent |
|---|---|
| 8, 10, 11, 13, 41, 144, 156, 201 | ABH [p-azidobenzoyl hydrazide] ASBA [4-(p-azidosalicylamido)-butylamine] |

Table IVC shows acylfulvene aldehyde analogs which can be attached to a bi-functional linker, where the linker also contains an amine reactive group which can attach to the AM using the reagent.

| Aldehyde analog | Reagent |
|---|---|
| 8, 10, 11, 13, 41, 144, 156, 201 | EDC [1-ethyl-3-(3-dimethylaminopropyl) carbodiimide hydrochloride] CMC [1-cyclohexyl-3-2(2-morpholinoethyl)carbodiimide] AADH [adipic acid dihydrazide] C6-SANH [C6-succinimidyl 4-hydraznonicotinate acetone hydrazone] SANH [succinimidyl 4-hydraznonicotinate acetone hydrazone] Carbohydrazide [1,3-diamonourea] |

Table VA shows acylfulvene alcohol analogs which can be attached to a bi-functional linker which can be attached to a sulthydryl reacting group of the AM using the reagent.

| Alcohol analog | Reagent |
|---|---|
| Illudin S, Illudin M, 2, 6, 9, 15,19, 22, 23, 32, 42, 56, 62, 63, 77, 78, 81, 90, 99, 103, 117, 118, 119, 127, 128, 135, 136, 145, 155, 159, 162, 187, 200, 204, 208, 277 & 279 & 280, 299, 300, 307, 308 | PMPI [N-(p-maleimidophenyl)isocyanate] |

Table VB shows acylfulvene alcohol analogs which can be attached to a bi-functional linker, where the linker also contains an amine reactive group which can attach to the AM using the reagent.

| Alcohol analog | Reagent |
|---|---|
| Illudin S, Illudin M, 2, 6, 9, 15,19, 22, 23, 32, 42, 56, 62, 63, 77, 78, 81, 90, 99, 103, 117, 118, 119, 127, 128, 135, 136, 145, 155, 159, 162, 187, 200, 204, 208, 277 & 279 & 280, 299, 300, 307, 308 | CDI [N,N'-carbonyldiimidazole], DSC [N,N'-disuccinimidyl carbonate], HSC [N-hydroxysuccinimidyl chloroformate] |

Table VIA shows acylfulvene sulthydryl analogs which can be attached to a bi-functional linker, where the linker also contains an amine reactive group which can attach to the AM using the reagent.

| Sulfhydryl analog | Reagent |
|---|---|
| Analog 51 Terminal cysteine or n-acetyl cysteine | AMAS [N-(α-maleimidoacetoxy)-succinimide ester [BMPA [N-β-malemidopropionic acid] BMPS [N-β-(malemidopropyloxy)succinimide ester] EMCH [N-(episilon-maleimidocaproic acid) hydrazide] EMCS [N-(episilon-maleimideocaproyloxy)succinimide ester] GMBS [N-(gamma-maleimideobutyrloxy)succinimide ester] KMUA [N-kappa-maleimidoundecanoic acid] KMUH [N-(kappa-maleimidoundecanoic acid) hydrazide] LC-SMCC [sucinimidyl 4-(N-maleimidomethyl)cyclohexane-1-carboxy-(6-amidocaproate)] LC-SDPD [succinimidyl 6-(3'-(2-pyridyl-dithio)propionamido)hexanoate] MBS [m-maleimidobenzoyl-N-hydroxysuccinimide ester] M2C2H [4-(N-maleimidomethyl)cyclohexanee-1-1carboxyl-hydrazide] MPBH [4-(4-N-maleimidophenyl)-butyric acid hydrazide] PDPH [3-(2-pyridyldithio)propionylhydrazide] PMPI [N-(p-maleimidophenyl)isocyanate] SBAP [succinimidyl 3-bromoacetamido)propionate] SHTH [succinimidyl 4-hydrazidoterephthalate] SIA [N-succinimidyl iodacetate] SIAB [N-succinimidyl(4-iodoacetyl)aminobenzoate] SMCC [succinimidyl 4-(N-maleimidomethyl)-cyclohexane-1-carboxylate] SMPB [succinimidyl 4-(para-maleimido-phenyl)butyrate] SMPH [succinimidyl-6-(beta-maleimidopropionamido)hexanoate] SM(PEG)2 [NHS-PEO$_2$-maleimide or maleimide PEG2 N-hydroxysuccinimide] SM(PEG)4 [NHS-PEO$_4$-maleimide or maleimide PEG4 N-hydroxysuccinimide] SM(PEG)8 [NHS-PEO$_8$-maleimide or maleimide PEG6 N-hydroxysuccinimide] SM(PEG)12 [NHS-PEO$_{12}$-mleimide or maleimide PEG8 N-hydroxysuccinimide] SMPH [succinimidyl-6-(beta-maleimidopropionamido)hexanoate] SMPT [4-succinimidyloxycarbonyl-methyl-alpha-(2-pyridyldithio)toluene] SPDP [N-succinimidyl 3-(2-pyridyldithio)propionate] Sulfo-EMCS [N-(episilon-maleimideocaproyloxy)sulfosuccinimide] Sulfo-GMBS [N-(gamma-maleimidobutyrloxy)sulfosuccinimide ester] Sulfo-KMUS [N-(kappa-maleimidoundecanoyloxy)sulfosuccinimide ester] Sulfo-LC-SMPT [sulfosuccinimidyl 6-(alpha-methyl-alpha-(2-[pyridyldithio)-toluamido)hexanoate], Sulfo-LC-SPDP [sulfosuccinimidyl 6-(3'-(2-pyridyl-dithio)propionamido)hexanoate], Sulfo-MBS [m-maleimidobenzoyl-N-hydroxysulfosuccinimide ester], Sulfo-SIAB [sulfosuccimidyl(4-iodo-acetyl)aminobenzoatel, Sulfo-SMCC [sulfosuccimidyl 4-(N-maleimido-methyl)cyclohexane-1-carboxylate], Sulfo-SMPB [sulfosuccimidyl 4-(p-maleimidophenyl)butyrate] |

Table VIB shows acylfulvene sulfhydryl analogs which can be attached to a bi-functional linker, where the linker also contains a sulfhydryl reacting group which can attach to AM using reagent.

| Sulfhydryl analog | Reagent |
|---|---|
| Analog 51, Terminal cysteine or n-acetyl | BMB [ 1,4-bis-maleimidobutane ], BMDB [ 1,4-bis-maleimidyl-2,3-hydroxybutyrate ], BMH [ bis-maleimidehexane ], BMOE [ bis-maleimideethanol], |
| cysteine | BM[PEO]2 [1, 8-bis-malemidodiethyene-glycol ], BM[PEO]3 [1, 11-bis-malemidotriethyene-glycol ], DPDPB [ 1,4-di(3'-(2'pyridyldithio)propionamido)butane ], DTME [ dithio-bis-(sulfosuccinimidylpropionate) ], HBVS [ 1,6-hexane-bis-vinylsulfone ] |

Table VIC shows acylfulvene sulfhydryl analogs which can be attached to a bi-functional linker, where linker also contains photoactivatable reactive group which can attach to AM using reagent.

| Sulfhydryl analog | Reagent |
|---|---|
| Analog 51,Terminal cysteine or acetyl cysteine | APDP [ N-(4-(p-azidosalicylamido)butyl)-3'-(2'-pyridyldithio)propionamide ] |

Table VID shows acylfulvene sulfhydryl analogs which can be attached to a bi-functional linker, where the linker also contains a carboxylate reactive group which can attach to AM using reagent.

| Sulfhydryl analog | Reagent |
|---|---|
| Analog 51,Terminal cysteine or n-acetyl cysteine | EMCA [ N-(epsilon-maleimidocaproic acid) ] |

Table VII shows the cytotoxic data $IC_{50}$ values (micromolar, 2 hour exposure, N=3, mean±SD) for Illudin M, analog 108 and analog 110 for cells expressing the estrogen receptor (ER) (MCF7) and cells not expressing the ER (HT29).

| Analog | HT29 (ER Negative) | MCF7 (ER positive) |
|---|---|---|
| Illudin M | 0.52 ± 0.10 | 0.48 ± 0.13 |
| 108 | >55 | 14.1 ± 2.8 |
| 110 | >19 | 2.0 ± 0.1 |

Table VIII shows the activity of PSA cleavable acylfulven analogs (210, 215, 216, 221) and precursor analogs against PSA negative and PSA positive cell line (48 hour exposure, N=3; mean±SD; IC50 values in nM).

| Analog | Prostate PC3 (negative PSA) | Prostate DuPro (trace PSA) | Prostate LnCAP (positive PSA) |
|---|---|---|---|
| Illudin S | 16 ± 5 | 11 ± 3 | 15 ± 3 |
| 204 (Illudin S tosylate) | n.t. | n.t. | 3,300 ± 1,000 |
| 207 (9-amine-leucine) | 880 ± 330 | 450 ± 40 | 560 ± 60 |
| 211 (9-amine) | 350 ± 80 | 280 ± 20 | 270 ± 50 |
| 212 (Illudin M-proline) | 120 ± 20 | 20 ± 2 | 120 ± 30 |
| 213 (Illudin S-tosylate-proline) | 2,200 ± 100 | 360 ± 80 | 900 ± 200 |
| 214 (Illudin S-Pro-Ser-Ser-HOAc) | 300 ± 50 | 90 ± 10 | 190 ± 30 |
| 0 (9-ester linkage/Ac-Hyp-Ser-Ser-Chg-G Gln-Ser-Pro) | 4,700 ± 500 | 3,500 ± 400 | 810 ± 130 |
| 215 (Illudin S-tosylate ester/Ac-Hyp-Ser-Se Chg-Gln-Gln-Ser-Pro) | n.t. | n.t. | > 20,000 |
| 16 (Illudin M/ester/Ac-Hyp-Ser-Ser-Chg-G Gln-Ser-Pro) | 190 ± 10 | 280 ± 60 | 190 ± 30 |
| 221 (211/amide or nonester) Mu-His-Ser-Ser-Lys(Fmoc)-Leu-Gln-Leu | >21,000 | 13,000 ± 1,000 | 800 ± 100 | n.t. denotes not tested

Table IX showing peptides cleaved by proteases.

| Protease | Peptide | SEQ. ID's |
|---|---|---|
| PSA | His-Ser-Ser-Lys-Leu-Gln-X | SEQ. ID. 104 |
| | Mu-His-Ser-Ser-Lys-Leu-Gln-X | |
| | Mu-His-Ser-Ser-Lys-Leu-Gln-Lys-X | SEQ. ID. 106 |
| | Mu-His-Ser-Ser-Lys-Leu-EDA-Lys-X | SEQ. ID. 108 |
| | Mc-His-Ser-Ser-Lys-Leu-Gln-X | |
| | Mc-His-Ser-Ser-Lys-Leu-Gln-X | |
| | Hyp-Ala-Ser-Chg-Gln-Ser-X | SEQ. ID. 111 |
| | Hyp-Ala-Ser-Chg-Gln-Ser-Leu-X | SEQ. ID. 116 |
| | Mu-Hyp-Ala-Ser-Chg-Gln-Ser-X | |
| | Mu-Hyp-Ala-Ser-Chg-Gln-Ser-Leu-X | |
| | Mc-Hyp-Ala-Ser-Chg-Gln-Ser-X | |
| | Mc-Hyp-Ala-Ser-Chg-Gln-Ser-Leu-X | |
| | Hyp-Ser-Ser-Chg-Gln-Ser-Ser-Pro-X | SEQ. ID. 127 |
| | Mu-Hyp-Ser-Ser-Chg-Gln-Ser-Ser-Pro-X | |
| | Mc-Hyp-Ser-Ser-Chg-Gln-Ser-Ser-Pro-X | |
| | 4-O-Ac-Hyp-Ser-Ser-Chg-Gln-Ser-Ser-Pro-X | SEQ. ID. 131 |
| | Arg-Arg-Ser-Ser-Tyr-Tyr-Ser-Gly-X | SEQ. ID. 132 |
| | Mu-Arg-Arg-Ser-Ser-Tyr-Tyr-Ser-Gly-X | |
| | Mc-Arg-Arg-Ser-Ser-Tyr-Tyr-Ser-Gly-X | |
| | Mc-Ser-Ser-Lys-Tyr-Gln-Leu-X | SEQ. ID. 136 |
| | Mu-Ser-Ser-Lys-Tyr-Gln-Leu-X | |
| | N-glutaryl-Hyp-Ala-Ser-chGly-Gln-Ser-Leu | SEQ. ID. 137 |
| | Mu-N-glutaryl-Hyp-Ala-Ser-chGly-Gln-Ser-Leu | |
| | Mc-N-glutaryl-Hyp-Ala-Ser-chGly-Gln-Ser-Leu | |
| Caspase-3 | Asp-Glu-Val-Asp-Pro-X | SEQ. ID. 138 |
| | Mu-Asp-Glu-Val-Asp-Pro-X | |
| | Mc-Asp-Glu-Val-Asp-Pro-X | |
| | Lys-Gly-Ser-Gly-Asp-Val-Glu-Gly-X | SEQ. ID. 139 |
| | Mu-Lys-Gly-Ser-Gly-Asp-Val-Glu-Gly-X | |
| | Mc-Lys-Gly-Ser-Gly-Asp-Val-Glu-Gly-X | |

-continued

| Protease | Peptide | SEQ. ID's |
|---|---|---|
| Cathepsin B | PLE-X | |
| | Gly-Phe-Leu-Gly-X | SEQ. ID. 141 |
| | Lys-Lys-Phe-D-Ala-X | SEQ. ID. 142 |
| | D-Ala-Phe-Lys-Lys-X | SEQ. ID. 144 |
| | Mc-Poly-L-glutamic acid-X | |
| | Mc-Gly-Phe-Leu-Gly-X | SEQ. ID. 145 |
| | Mc-Lys-Lys-Phe-D-Ala-X | |
| | Mc-D-Ala-Phe-Lys-Lys-X | |
| | Mu-Poly-L-glutamic acid-X | |
| | Mu-Gly-Phe-Leu-Gly-X | |
| | Mu-Lys-Lys-Phe-D-Ala-X | |
| | Mu-D-Ala-Phe-Lys-Lys-X | |
| | Val-Cit-X | |
| FAP | Lys-Gln-Glu-Gln-Asn-Pro-Gly-Ser-Thr-X | SEQ. ID. 146 |
| | Mu-Lys-Gln-Glu-Gln-Asn-Pro-Gly-Ser-Thr-X | |
| | Mc-Lys-Gln-Glu-Gln-Asn-Pro-Gly-Ser-Thr-X | |
| Kallikrein 2 | Gly-Lys-Ala-Phe-Arg-Arg-X | SEQ. ID. 171 |
| | Mu-Gly-Lys-Ala-Phe-Arg-Arg-X | |
| | Mc-Gly-Lys-Ala-Phe-Arg-Arg-X | |
| MMP-2/-9/ | Glu-Pro-Cit-Gly-Hof-Tyr-Leu-X | SEQ. ID. 172 |
| | Mu-Glu-Pro-Cit-Gly-Hof-Tyr-Leu-X | |
| | Mc-Glu-Pro-Cit-Gly-Hof-Tyr-Leu-X | |
| | Gly-Ile-Leu-Gly-Val-Pro-X | SEQ. ID. 173 |
| | Mu-Gly-Ile-Leu-Gly-Val-Pro-X | |
| | Mc-Gly-Ile-Leu-Gly-Val-Pro-X | |
| | Gly-Pro-Leu-Gly-Ile-Ala-Gly-Gln-X | SEQ. ID. 174 |
| | Mu-Gly-Pro-Leu-Gly-Ile-Ala-Gly-Gln-X | |
| | Mc-Gly-Pro-Leu-Gly-Ile-Ala-Gly-Gln-X | |
| MMP-7 | Lys-Arg-Ala-Leu-Gly-Leu-Pro-Gly | SEQ. ID. 175 |
| | Mu-Lys-Arg-Ala-Leu-Gly-Leu-Pro-Gly | |
| | Mc-Lys-Arg-Ala-Leu-Gly-Leu-Pro-Gly | |
| | Arg-Pro-Leu-Ala-Leu-Trp-Arg-Ser | SEQ. ID. 176 |
| | Mu-Arg-Pro-Leu-Ala-Leu-Trp-Arg-Ser | |
| | Mc-Arg-Pro-Leu-Ala-Leu-Trp-Arg-Ser | |
| TOP | Ala-L-L-Ala-L-Ile | |
| | Mu-Ala-L-L-Ala-L-Ile | |
| | Mc-Ala-L-L-Ala-L-Ile | |
| uPA | D-Ala-Phe-Lys or | SEQ. ID. 177 |
| | D-Ala-Phe-Lys-PABC | |
| Cathepsin K | Gly-Gly-Pro-Nle-X | SEQ. ID. 178 |
| | Mu-Gly-Gly-Pro-Nle-X | |
| | Mc-Gly-Gly-Pro-Nle-X | |
| Plasmin | D-Ala-Phe-Lys-Lys-X | SEQ. ID. 179 |
| | Mu-D-Ala-Phe-Lys-Lys-X | |
| | Mc-D-Ala-Phe-Lys-Lys-X | |
| | D-Ala-Phe-Lys-X | |
| | Mu-D-Ala-Phe-Lys-X | |
| | Mc-D-Ala-Phe-Lys-X | |
| Thrombin | Poly-L-Lys-Gly-D-Phe-Pip-Arg-Ser-Gly-Gly-Gly-Gly-Gly-X | SEQ. ID. 180 |
| Trypsin | Poly-L-Lysine-Gly-Ala-Ser-D-Arg-Phe-Thr-Gly-X | SEQ. ID. 181 |

In Table IX, the letter 'X' denotes the end attached to the medicant, Chg denotes cyclohexyl glycine, Cit denotes citrulline, EDA denotes ethanyl-D-Alanine, Hof denotes homophenylalanine, Hyp denotes 4-hydroxyproline, Mc denotes morpholinocarbonyl (carboxy-terminal protecting group), Mu denotes 4-morpholine-carbonyl (amino-terminal protecting group), Nle denotes norleucine, PABC denotes para-aminobenzoylcarboxyl, PLE denotes Poly-L-glutamic acid, Pip denotes piperidine.

Table X shows different Linker Strategies.

| Linker Reactive Group* | IDer | Functional Group | Bond product |
|---|---|---|---|
| FSB | 1220 | Carboxylate | Ester |
| FSB | 1220 | Hydroxyl | Ether |
| Isothiocyanate | 1241 | Primary Amine | Isothiourea |
| Isocyanate | 1242 | Primary Amine | Isourea |
| Cyanate ester | | Primary Amine | Isourea |

| Linker Reactive Group* | IDer | Functional Group | Bond product |
| --- | --- | --- | --- |
| Acyl Azide | 1243 | Primary Amine | Amide |
| NHS Ester | 1244 | Primary Amine | Amide |
| Sulfonyl chloride | 1245 | Primary Amine | Sulfonamide |
| Tosylate Ester | | Thiol | Thioether |
| Tosylate Ester | | Primary Amine | Secondary Amine |
| Tosylate Ester | | Hydroxyl | Ether |
| Tresyl | | Ester Primary Amine | Sulfonamide |
| Aldehyde | | Primary Amine | Secondary Amine |
| Epoxide | | Primary Amine | Secondary Amine |
| Carboxylate | | Primary Amine | Carbamate |
| Aryl Halide (Like Fluorobenzene) | | Primary Amine | Arylamine |
| Imidoester | 1248 | Primary Amine | Amidine |
| Carbodiimides (eg EDC or CMC) | | Primary Amine | Amide |
| Diimidazoles (like CDI) | | Primary Amine | Carbamate |
| Maleic anhydride | | Primary Amine | Amide |
| Alkylphosphate | | Primary Amine | Phosphoramidate |
| Succinic anhydride (like DSC) | 1247 | Primary Amine | Amide |
| Fluorophenyl esters | | Primary Amine | Amide |
| N,N'-disuccinimidyl carbonate | | Primary Amine | Carbamate |
| N-hydroxylsuccinimidyl chloroformate | | Primary Amine | Carbamate |
| Haloalkyl (like Iodoacetyl) | | Sulfhydryl | Thioester |
| Maleimide (like NEM) | | Sulfhydryl | Thioether |
| MAL I | 1210 | Sulfhydryl | Thioether |
| MAL I | 1211 | Sulfhydryl | Thioether |
| Maleimide | | Hexadienes | 2 + 4 |
| Aziridine | | Sulfhydryl | Thioether |
| Acryloyl | | Sulfhydryl | Thioether |
| Flurobenzene | | Sulfhydryl | Aryl Thioether |
| Pyridyl disulfide | | Sulfhydryl | Disulfide bond |
| 5-thio-2-nitrobenzoic acid (TNB) | | Sulfhydryl | Disulfide bond |
| Vinylsulfone (like HBVS) | | Sulfhydryl | Beta-thiosulfonyl |
| Diazoalkane or Diazoacetate | | Carboxylate | Ester |
| N,N'-carbonyl diimidazole | | Hydroxyl | Carbamate |
| Isocyanate | | Hydroxyl | Carbamate |
| Haloacetyl or alkyl halide | | Hydroxyl | Ether |
| Aminooxy | | Aldehyde | Oxime |
| Hydroxylamine | | Aldehyde | Oxime |
| Photolysis | | Aryl Azide | Nucleophilic addition |
| Photolysis | | Halogenated Aryl Azid | Nucleophilic addition |
| Azide/copper catalyst | | Alkene | Triazoline |
| Azide/copper catalyst | | Alkyne | Triazole |
| Aldehyde/NaCNBH3 | | Primary Amine | Secondary Amine |
| Amino acid | 1230 | Carboxylate/DCC | Azlactone |
| Azlactone | | Primary Amine | Amide |
| Woodward's/Carboxylate | | Primary Amine | Amide |
| DSP or DTSSP | | Primary Amines | Disulfide |
| DSS | | Primary Amines | Amide |
| DST and sulfo-DST | | Primary Amines | Amide |
| BSOCOES and sulfo-BSOCOES | | Primary Amines | Amide |
| EGS and sulfo-EGS | | Primary Amines | Amide |
| DSG | | Primary Amines | Amide |
| DMA | | Primary Amines | Amidines |
| DMP | | Primary Amines | Amidines |
| DMS | | Primary Amines | Amidines |
| DTBP | | Primary Amines | Disulfide |
| Difluorobenzene derivatives (DFDNB or DFDNPS) | | Primary Amines | Aryl secondary amines |
| Epoxide | | Sulfhydryl | Thioether |
| Epoxide | | Hydroxyl | Ether |
| Carbohydrazide | | Aldehyde | Hydrazone-Hydrazine |
| SPDP or Sulfo-SPDP or LC-SDPDP or Sulfo-LC-SDPDP | | Primary Amine | Amide |
| SPDP or Sulfo-SPDP or LC-SDPDP or Sulfo-LC-SDPDP | | Sulfhydryl | Disulfide |
| SMPT or Sulfo-LC-SMPT | | Primary Amine | Amide |
| SMPT or Sulfo-LC-SMPT | | Sulfhydryl | Disulfide |
| SMCC or Sulfo-SMCC or LC-SMCC or Sulfo LC-SMCC | | Primary Amine | Amide |
| SMCC or Sulfo-SMCC or LC-SMCC or Sulfo-LC-SMCC | | Sulfhydryl | Disulfide |
| MBS and sulfo-MBS | | Primary Amine | Amide |
| MBS and sulfo-MBS | | Sulfhydryl | Thioether |
| SIA/B and sulfo-SIA/B | | Primary Amine | Amide |
| SIAB and sulfo-SIAB | | Sulfhydryl | Thioether |
| SIAC or SIACX or SIAX or SIAXX | | Primary Amine | Amide |
| SIAC or SIACX or SIAX or SIAXX | | Sulfhydryl | Thioether |
| GMBS and sulfo-GMBS | | Primary Amine | Amide |
| GMBS and sulfo-GMBS | | Sulfhydryl | Thioether |
| MPBH | | Sulfhydryl | Thioether |
| MPBH | | Carbonyl | Amide/Hydrazone |
| M2C2H | | Sulfhydryl | Thioether |
| M2C2H | | Carbonyl | Amide |
| PDPH | | Sulfhydryl | Disulfide |
| PDPH | | Carbonyl | Amide/Hydrazone |
| NHS-ASA | | Primary Amine | Photoreactive Aryl Azide |
| Sulfo-NHS-ASA | | Primary Amine | Photoreactive Aryl Azide |
| Sulfo-NHS-LC-ASA | | Primary Amine | Photoreactive Aryl Azide |
| HSAB and Sulfo-HSAB | | Primary Amine | Photoreactive Azide with Amide |
| SANPAH and Sulfo-SANPAH | | Primary Amine | Photoreactive Azide with Amide |
| ANB-NOS | | Primary Amine | Photoreactive Azide with Amide |
| SAND and Sulfo-SAND | | Primary Amine | Photoreactive Azide with Amide |
| SADP and Sulfo-SADP | | Primary Amine | Photoreactive Azide with Amide |
| SAPB and Sulfo-SAPB | | Primary Amine | Photoreactive Azide with Amide |
| SAED and Sulfo-SAED | | Primary Amine | Photoreactive Azide with Amide |
| Sulfo-SAMCA | | Primary Amine | Photoreactive Azide with Amide |
| Sulfo-SASD | | Primary Amine | Photoreactive Azide with Amide |
| Sulfo-SFAD | | Primary Amine | Photoreactive Azide with Amide |
| pNDPD | | Primary Amine | Photoreactive Azide with Amide |
| PNP-DTP | | Primary Amine | Photoreactive Diazo with Amide |
| APDP | | Sulfhydryl | Photoreactive Azide with Thioether |
| ABH | | Aldehyde | Photoreactive Azide with Hydrazor |
| ASBA | | Carboxylate | Photoreactive Azide with Amide |
| SPB | | Primary Amine | Photoreactive Psoralen group with Amide |
| PMPA or PMPS | | Sulfyhydryl | Thioether |
| SANH or SHNH or SHTH | | Primary Amine | Amide |

-continued

| Linker Reactive Group* | IDer | Functional Group | Bond product |
|---|---|---|---|
| SANH or SHNH or SHTH | | Aldehyde | Hydrazone |
| BMPA or BMPS | | Sulfhydryl | Thioether |
| BMPA or BMPS | | Primary Amine | Amide |
| SATA or SATP or SAMSA | | Primary Amine | Amide |
| SATA or SATP or SAMSA | | Hydroxylamine | Sulfhydryl |
| AMBH | | Aldehyde | Hydrazone |
| PMPI | | Sulfhydryl | Thioether |
| PMPI | | Hydroyxl | Carbamate |
| AADH | | Aldehyde | Hydrazone |
| AMAS | | Primary Amine | Amide |
| AMAS | | Sulfhydryl | Thioether |
| KMUS or Sulfo-KMUS | | Primary Amine | Amide |
| KMUS or Sulfo-KMUS | | Sulfhydryl | Thioether |
| EMCH or EMCS or sulfo-EMCS | | Primary Amine | Amide |
| EMCH or EMCS or sulfo-EMCS | | Sulfhydryl | Thioether |
| BS2 or BS3 or BS(PEG)5 series | | Amine | Amide |
| Citiolone | | Primary Amine | Amide with free Sulfhydryl |
| SMPB or Sulfo-SMPB or SMPH or SBAI | | Primary Amine | Amide |
| SMPB or Sulfo-SMPB or SMPH or SBAI | | Sulfhydryl | Thioether |
| Woodward's Reagent K | | Carboxylate | Enol Ester Intermediate |
| " " Enol Ester Intermediate | | Primary Amine | Amide |
| KMUA | | Sulfhydryl | Thioether |
| KMUA | | mary Amine in presenc EDC | Amide |
| KMUH | | Sulfhydryl | Thioether |
| KMUH | | Aldehyde or Carboxylate | Hydrazone |
| BMPH | | Sulfhydryl | Thioether |
| BMPH | | Aldehyde or Carboxylate | Hydrazone |
| PDTP | | Primary Amine | Amide |
| SFB or SFPA | | Primary Amine | Amide with free aldehyde |
| SM(PEG)n Series | | Primary Amine | Amide |
| SM(PEG)n Series | | Sulfhydryl | Thioether |
| DPDPB | | Two Sulfhydryls | Two Disulfides |
| BMH[PEO]n series | | Two Sulfhydryls | Two Thioethers |
| BMH or BMOE | | Two Sulfhydryls | Two Thioethers |
| BMB or BMDB | | Two Sulfhydryls | Two Thioethers |
| DTME | | Two Sulfhydryls | Two Thioethers with internal disulfide bond |
| NPIA | | Primary Amine | Amide |
| NPIA | | Sulfhydryl | Thioether |
| MCP | | Primary Amine | Amidine |

Abbreviation in Table X have been defined previously in Tables I through Table VI.

| Analog | | IUPAC Name of Illudofulvene Analog |
|---|---|---|
| 1 | 106 | 5-(((3'S,6'R)-6'-hydroxy-2',2',4',6'-tetramethyl-7'-oxo-2',3',6',7'-tetrahydrospiro[cyclopropane-1,5'-inden]-3'-yl)oxy)-5-oxopentanoic acid |
| 2 | 107 | (3'S,6'R)-6'-hydroxy-2',2',4',6'-tetramethyl-7'-oxo-2',3',6',7'-tetrahydrospiro[cyclopropane-1,5'-inden]-3'-yl ((13S)-13-methyl-17-oxo-7,8,9,11,12,13,14,15,16,17-decahydro-6H-cyclopenta[a]phenanthren-3-yl) glutarate |
| 3 | 108 | (13S)-17-hydroxy-13-methyl-7,8,9,11,12,13,14,15,16,17-decahydro-6H-cyclopenta[a]phenanthren-3-yl 3-((R)-6'-hydroxy-2',4',6'-trimethyl-7'-oxo-6',7'-dihydrospiro[cyclopropane-1,5'-inden]-3'-yl)propanoate |
| 4 | 109 | (13S)-17-hydroxy-13-methyl-7,8,9,11,12,13,14,15,16,17-decahydro-6H-cyclopenta[a]phenanthren-3-yl ((3'S,6'R)-6'-hydroxy-2',2',4',6'-tetramethyl-7'-oxo-2',3',6',7'-tetrahydrospiro[cyclopropane-1,5'-inden]-3'-yl) glutarate |
| 5 | 110 | (13S)-13-methyl-17-oxo-7,8,9,11,12,13,14,15,16,17-decahydro-6H-cyclopenta[a]phenanthren-3-yl 3-((R)-6'-hydroxy-2',4',6'-trimethyl-7'-oxo-6',7'-dihydrospiro[cyclopropane-1,5'-inden]-3'-yl)propanoate |
| 6 | 111 | (10R,13S)-10,13-dimethyl-3-oxo-2,3,6,7,8,9,10,11,12,13,14,15,16,17-tetradecahydro-1H-cyclopenta[a]phenanthren-17-yl 3-(6'-hydroxy-2',4'-dimethyl-7'-oxo-6',7'-dihydrospiro[cyclopropane-1,5'-inden]-3'-yl)propanoate |
| 7 | 112 | (13S)-10,13-dimethyl-17-oxohexadecahydro-1H-cyclopenta[a]phenanthren-3-yl 3-((R)-6'-hydroxy-2',4',6'-trimethyl-7'-oxo-6',7'-dihydrospiro[cyclopropane-1,5'-inden]-3'-yl)propanoate |
| 8 | 113 | (R)-3'-(but-3-en-1-yl)-6'-hydroxy-2',4',6'-trimethylspiro[cyclopropane-1,5'-inden]-7'(6'H)-one |
| 9 | 114 | (6'R)-6'-hydroxy-2',4',6'-trimethyl-3'-(2-(oxiran-2-yl)ethyl)spiro[cyclopropane-1,5'-inden]-7'(6'H)-one |
| 10 | 115 | (R)-3-(6'-hydroxy-2',4',6'-trimethyl-7'-oxo-6',7'-dihydrospiro[cyclopropane-1,5'-inden]-3'-yl)propanal oxime |
| 11 | 116 | (R)-3'-(tert-butoxymethyl)-6'-hydroxy-2',4',6'-trimethylspiro[cyclopropane-1,5'-inden]-7'(6'H)-one |
| 12 | 117 | 5-(((2'S,6'R)-3'-((4-carboxybutanoyl)oxy)-6'-hydroxy-2',4',6'-trimethyl-7'-oxo-2',3',6',7'-tetrahydrospiro[cyclopropane-1,5'-inden]-2'-yl)methoxy)-5-oxopentanoic acid |
| 13 | 118 | 5-(((2'S,6'R)-2'-(((3,5-dinitrobenzoyl)oxy)methyl)-6'-hydroxy-2',4',6'-trimethyl-7'-oxo-2',3',6',7'-tetrahydrospiro[cyclopropane-1,5'-inden]-3'-yl)oxy)-5-oxopentanoic acid |
| 14 | 119 | (6'R)-3'-(3,4-dihydroxybutyl)-6'-hydroxy-2',4',6'-trimethylspiro[cyclopropane-1,5'-inden]-7'(6'H)-one |
| 15 | 120 | (R)-6'-hydroxy-3'-(3-((3-((S)-6'-hydroxy-2',4',6'-trimethyl-7'-oxo-6',7'-dihydrospiro[cyclopropane-1,5'-inden]-3'-yl)propylidene)hydrazineylidene)propyl)-2',4',6'-trimethylspiro[cyclopropane-1,5'-inden]-7'(6'H)-one |
| 16 | 121 | (R)-2-(3-(6'-hydroxy-2',4',6'-trimethyl-7'-oxo-6',7'-dihydrospiro[cyclopropane-1,5'-inden]-3'-yl)propylidene)hydrazine-1-carboxamide |
| 17 | 122 | (R)-6'-hydroxy-2',4',6'-trimethyl-3'-(3-(2-phenylhydrazineylidene)propyl)spiro[cyclopropane-1,5'-inden]-7'(6'H)-one |
| 18 | 123 | (R)-N'-(3-(6'-hydroxy-2',4',6'-trimethyl-7'-oxo-6',7'-dihydrospiro[cyclopropane-1,5'-inden]-3'-yl)propylidene)-4-methylbenzenesulfonohydrazide |
| 19 | 124 | (R)-3-(6'-hydroxy-2',4',6'-trimethyl-7'-oxo-6',7'-dihydrospiro[cyclopropane-1,5'-inden]-3'-yl)propanal O-acetyl oxime |
| 20 | 125 | (R)-3'-(3-(2-(2,4-dinitrophenyl)hydrazineylidene)propyl)-6'-hydroxy-2',4',6'-trimethylspiro[cyclopropane-1,5'-inden]-7'(6'H)-one |
| 21 | 126 | (R)-6'-hydroxy-2',4',6'-trimethyl-7'-oxo-6',7'-dihydrospiro[cyclopropane-1,5'-inden]-3'-carbaldehyde oxime |

-continued

| Analog | | IUPAC Name of Illudofulvene Analog |
|---|---|---|
| 22 | 127 | 2-hydroxy-4-((R)-6'-hydroxy-2',4',6'-trimethyl-7'-oxo-6',7'-dihydrospiro[cyclopropane-1,5'-inden]-3'-yl)butanenitrile |
| 23 | 128 | (6'R)-6'-hydroxy-3'-(3-hydroxybutyl)-2',4',6'-trimethylspiro[cyclopropane-1,5'-inden]-7'(6'H)-one |
| 24 | 129 | (6'R)-2',4',6'-trimethyl-6',7'-dihydrospiro[cyclopropane-1,5'-inden]-6',7'-diol |
| 25 | 130 | (R)-6'-hydroxy-3'-(3-(hydroxyamino)propyl)-2',4',6'-trimethylspiro[cyclopropane-1,5'-inden]-7'(6'H)-one |
| 26 | 131 | (R)-N-benzyl-3-(6'-hydroxy-2',4',6'-trimethyl-7'-oxo-6',7'-dihydrospiro[cyclopropane-1,5'-inden]-3'-yl)propanamide |
| 27 | 133 | (E)-7-(chloromethylene)-5-hydroxy-5,9-dimethylspiro[3.5]non-8-en-6-one |
| 28 | 134 | (E)-6-(chloromethylene)-4-hydroxy-4,8-dimethylspiro[2.5]oct-7-en-5-one |
| 29 | 135 | ((2'S,6'R)-3',6'-dihydroxy-2',4',6'-trimethyl-7'-oxo-2',3',6',7'-tetrahydrospiro[cyclopropane-1,5'-inden]-2'-yl)methyl 4-nitrobenzoate |
| 30 | 136 | ((2'S,6'R)-3',6'-dihydroxy-2',4',6'-trimethyl-7'-oxo-2',3',6',7'-tetrahydrospiro[cyclopropane-1,5'-inden]-2'-yl)methyl 4-(N-acetoxyacetamido)benzoate |
| 31 | 137 | ((2'S,6'R)-6'-hydroxy-2',4',6'-trimethyl-3',7'-dioxo-2',3',6',7'-tetrahydrospiro[cyclopropane-1,5'-inden]-2'-yl)methyl 4-nitrobenzoate |
| 32 | 138 | ((2'S,6'R)-6'-hydroxy-2',4',6'-trimethyl-3',7'-dioxo-2',3',6',7'-tetrahydrospiro[cyclopropane-1,5'-inden]-2'-yl)methyl 4-(N-acetoxyacetamido)benzoate |
| 33 | 139 | (2'S,6'R)-6'-hydroxy-2',4',6'-trimethyl-2'-(((4-nitrobenzoyl)oxy)methyl)-7'-oxo-2',3',6',7'-tetrahydrospiro[cyclopropane-1,5'-inden]-3'-yl 4-nitrobenzoate |
| 34 | 140 | ((2'S,6'R)-3'-((4-(N-acetoxyacetamido)benzoyl)oxy)-6'-hydroxy-2',4',6'-trimethyl-7'-oxo-2',3',6',7'-tetrahydrospiro[cyclopropane-1,5'-inden]-2'-yl)methyl 4-(N-acetoxyacetamido)benzoate |
| 35 | 141 | dimethyl (5'R)-4',5'-dihydroxy-5',7',9'-trimethyl-4',5'-dihydro-1'H-spiro[cyclopropane-1,6'-[1,3a]ethenoindene]-2',3'-dicarboxylate |
| 36 | 142 | dimethyl (5'R)-5'-hydroxy-5',7',9'-trimethyl-4'-oxo-4',5'-dihydro-1'H-spiro[cyclopropane-1,6'-[1,3a]ethenoindene]-2',3'-dicarboxylate |
| 37 | 143 | (R)-6'-hydroxy-1',2',4',6'-tetramethylspiro[cyclopropane-1,5'-inden]-7'(6'H)-one |
| 38 | 144 | (R)-2-((2'-ethyl-6'-hydroxy-4',6'-dimethyl-7'-oxo-6',7'-dihydrospiro[cyclopropane-1,5'-inden]-3'-yl)methoxy)ethyl acetate |
| 39 | 145 | (R)-5-((6'-hydroxy-2',4',6'-trimethyl-7'-oxo-6',7'-dihydrospiro[cyclopropane-1,5'-inden]-3'-yl)methoxy)-5-oxopentanoic acid |
| 40 | 146 | (R)-4-(6'-hydroxy-2',4',6'-trimethyl-7'-oxo-6',7'-dihydrospiro[cyclopropane-1,5'-inden]-3'-yl)butanenitrile |
| 41 | 147 | (R)-3'-((benzo[d]thiazol-2-ylthio)methyl)-6'-hydroxy-2',4',6'-trimethylspiro[cyclopropane-1,5'-inden]-7'(6'H)-one |
| 42 | 148 | (R)-3'-((benzo[d]oxazol-2-ylthio)methyl)-6'-hydroxy-2',4',6'-trimethylspiro[cyclopropane-1,5'-inden]-7'(6'H)-one |
| 43 | 149 | (R)-6'-hydroxy-2',4',6'-trimethyl-3'-(((1-methyl-1H-tetrazol-5-yl)thio)methyl)spiro[cyclopropane-1,5'-inden]-7'(6'H)-one |
| 44 | 150 | (R)-6'-hydroxy-2',4',6'-trimethyl-3'-(((5-methyl-1H-benzo[d]imidazol-2-yl)thio)methyl)spiro[cyclopropane-1,5'-inden]-7'(6'H)-one |
| 45 | 151 | (R)-6'-hydroxy-2',4',6'-trimethyl-3'-(((1-phenyl-1H-tetrazol-5-yl)thio)methyl)spiro[cyclopropane-1,5'-inden]-7'(6'H)-one |
| 46 | 152 | (R)-6'-hydroxy-2',4',6'-trimethyl-3'-(((5-nitro-1H-benzo[d]imidazol-2-yl)thio)methyl)spiro[cyclopropane-1,5'-inden]-7'(6'H)-one |
| 47 | 153 | (R)-3'-(((1H-1,2,4-triazol-3-yl)thio)methyl)-6'-hydroxy-2',4',6'-trimethylspiro[cyclopropane-1,5'-inden]-7'(6'H)-one |
| 48 | 154 | (R)-6'-hydroxy-3'-(((4-hydroxypteridin-2-yl)thio)methyl)-2',4',6'-trimethylspiro[cyclopropane-1,5'-inden]-7'(6'H)-one |
| 49 | 155 | (R)-6'-hydroxy-3'-(((1-(4-hydroxyphenyl)-1H-tetrazol-5-yl)thio)methyl)-2',4',6'-trimethylspiro[cyclopropane-1,5'-inden]-7'(6'H)-one |
| 50 | 156 | (R)-4-(5-(((6'-hydroxy-2',4',6'-trimethyl-7'-oxo-6',7'-dihydrospiro[cyclopropane-1,5'-inden]-3'-yl)methyl)thio)-1H-tetrazol-1-yl)phenyl acetate |
| 51 | 157 | 7'-methyl-4'H-dispiro[cyclobutane-1,6'-indene-5',2''[1,3]dioxolan]-4'-one |
| 52 | 158 | 5-hydroxy-2,2,6,8a-tetramethyl-2,3,3a,8,8a,8b-hexahydro-1H-cyclobuta[d]cyclopenta[b]oxepin-7(5H)-one |
| 53 | 159 | ((6'R)-3',6'-dihydroxy-2',4',6'-trimethyl-7'-oxo-2',3',6',7'-tetrahydrospiro[cyclopropane-1,5'-inden]-2'-yl)methyl acetate |
| 54 | 160 | 5-(((6'R)-2'-(acetoxymethyl)-6'-hydroxy-2',4',6'-trimethyl-7'-oxo-2',3',6',7'-tetrahydrospiro[cyclopropane-1,5'-inden]-3'-yl)oxy)-5-oxopentanoic acid |
| 55 | 161 | ((6'R)-6'-hydroxy-2',4',6'-trimethyl-3',7'-dioxo-2',3',6',7'-tetrahydrospiro[cyclopropane-1,5'-inden]-2'-yl)methyl acetate |
| 56 | 162 | 5-(((6'R)-6'-hydroxy-2',4',6'-trimethyl-3',7'-dioxo-2',3',6',7'-tetrahydrospiro[cyclopropane-1,5'-inden]-2'-yl)methoxy)-5-oxopentanoic acid |
| 57 | 163 | (6'R)-2'-(acetoxymethyl)-6'-hydroxy-2',4',6'-trimethyl-7'-oxo-2',3',6',7'-tetrahydrospiro[cyclopropane-1,5'-inden]-3'-yl 2-chloroacetate |
| 58 | 164 | (R)-(6'-hydroxy-2',4',6'-trimethyl-7'-oxo-6',7'-dihydrospiro[cyclopropane-1,5'-inden]-3'-yl)methyl 2-chloroacetate |
| 59 | 165 | (R)-(6'-hydroxy-2',4',6'-trimethyl-7'-oxo-6',7'-dihydrospiro[cyclopropane-1,5'-inden]-3'-yl)methyl 2-morpholinoacetate |
| 60 | 166 | (6'R)-2'-(acetoxymethyl)-6'-hydroxy-2',4',6'-trimethyl-7'-oxo-2',3',6',7'-tetrahydrospiro[cyclopropane-1,5'-inden]-3'-yl methyl glutarate |
| 61 | 167 | (6'R)-6'-hydroxy-2'-(hydroxymethyl)-2',4',6'-trimethyl-7'-oxo-2',3',6',7'-tetrahydrospiro[cyclopropane-1,5'-inden]-3'-yl methyl glutarate |
| 62 | 168 | ((6'R)-6'-hydroxy-2',4',6'-trimethyl-3',7'-dioxo-2',3',6',7'-tetrahydrospiro[cyclopropane-1,5'-inden]-2'-yl)methyl methyl glutarate |
| 63 | 169 | ((6'R)-6'-hydroxy-2',4',6'-trimethyl-3',7'-dioxo-2',3',6',7'-tetrahydrospiro[cyclopropane-1,5'-inden]-2'-yl)methyl 2-chloroacetate |
| 64 | 171 | 6-(2-hydroxyethyl)-2,5,7-trimethyl-1-methylene-1H-inden-4-ol |
| 65 | 172 | 6-ethyl-2,5,7-trimethyl-1-methylene-1H-inden-4-ol |
| 66 | 173 | 2-(4-hydroxy-2,5,7-trimethyl-1-methylene-1H-inden-6-yl)ethyl acetate |
| 67 | 174 | 5-(2-hydroxyethyl)-3-(hydroxymethyl)-2,4,6-trimethyl-1H-indene-1,7-diol |
| 68 | 175 | (2S,3S,4R,5S,6R)-2-(acetoxymethyl)-6-(((R)-6'-hydroxy-2',4',6'-trimethyl-7'-oxo-6',7'-dihydrospiro[cyclopropane-1,5'-inden]-3'-yl)methoxy)tetrahydro-2H-pyran-3,4,5-triyl triacetate |
| 69 | 177 | (R)-5-(3-(6'-hydroxy-2',4',6'-trimethyl-7'-oxo-6',7'-dihydrospiro[cyclopropane-1,5'-inden]-3'-yl)propoxy)-5-oxopentanoic acid |

-continued

| Analog | | IUPAC Name of Illudofulvene Analog |
|---|---|---|
| 70 | 178 | (R)-4-(3-(6'-hydroxy-2',4',6'-trimethyl-7'-oxo-6',7'-dihydrospiro[cyclopropane-1,5'-inden]-3'-yl)propoxy)-4-oxobutanoic acid |
| 71 | 179 | (R)-3-(6'-hydroxy-2',4',6'-trimethyl-7'-oxo-6',7'-dihydrospiro[cyclopropane-1,5'-inden]-3'-yl)propyl glycinate |
| 72 | 180 | (1a'R,3'R,7'S,7a'R)-3',7'-dihydroxy-1a',3',6',6'-tetramethyl-6',7'-dihydro-1a'H-spiro[cyclopropane-1,2'-indeno[3a,4-b]oxiren]-4'(3'H)-one |
| 73 | 181 | ((1a'R,3'R,6'S,7'S,7a'R)-3',7'-dihydroxy-1a',3',6'-trimethyl-4'-oxo-3',4',6',7'-tetrahydro-1a'H-spiro[cyclopropane-1,2'-indeno[3a,4-b]oxiren]-6'-yl)methyl acetate |
| 74 | 182 | (2'R,7'S,7a'S)-2'-chloro-7'-hydroxy-2',4'-dimethyl-1',2',7',7a'-tetrahydrospiro[cyclopropane-1,5'-indene]-3',6'-dione |
| 75 | 183 | (2'S,7'S,7a'S)-7'-hydroxy-2'-isopropoxy-2',4'-dimethyl-1',2',7',7a'-tetrahydrospiro[cyclopropane-1,5'-indene]-3',6'-dione |
| 76 | 188 | (6'S,6''S)-3',3'''-methylenebis(6'-hydroxy-2',4',6'-trimethylspiro[cyclopropane-1,5'-inden]-7'(6'H)-one) |
| 77 | 189 | (R)-1-((6'-hydroxy-2',4',6'-trimethyl-7'-oxo-6',7'-dihydrospiro[cyclopropane-1,5'-inden]-3'-yl)methyl)-1H-pyrrole-2,5-dione |
| 78 | 190 | (R)-1-(3-(6'-hydroxy-2',4',6'-trimethyl-7'-oxo-6',7'-dihydrospiro[cyclopropane-1,5'-inden]-3'-yl)propyl)-1H-pyrrole-2,5-dione |
| 79 | 191 | 6'-hydroxy-4',6'-dimethylspiro[cyclobutane-1,5'-inden]-7'(6'H)-one |
| 80 | 192 | (R)-2-((6'-hydroxy-2',4',6'-trimethyl-7'-oxo-6',7'-dihydrospiro[cyclopropane-1,5'-inden]-3'-yl)methyl)isoindoline-1,3-dione |
| 81 | 193 | (R)-3'-(azidomethyl)-6'-hydroxy-2',4',6'-trimethylspiro[cyclopropane-1,5'-inden]-7'(6'H)-one |
| 82 | 194 | (R)-3'-(((R)-3'-(azidomethyl)-6'-hydroxy-2',4',6'-trimethyl-7'-oxo-6',7'-dihydrospiro[cyclopropane-1,5'-inden]-1'-yl)methyl)-6'-hydroxy-2',4',6'-trimethylspiro[cyclopropane-1,5'-inden]-7'(6'H)-one |
| 83 | 195 | (R)-3'-(3-azidopropyl)-6'-hydroxy-4',6'-dimethylspiro[cyclopropane-1,5'-inden]-7'(6'H)-one |
| 84 | 196 | 3-((R)-6'-hydroxy-2',4',6'-trimethyl-7'-oxo-6',7'-dihydrospiro[cyclopropane-1,5'-inden]-3'-yl)propyl L-prolinate |
| 85 | 197 | (R)-2-(3-(6'-hydroxy-2',4',6'-trimethyl-7'-oxo-6',7'-dihydrospiro[cyclopropane-1,5'-inden]-3'-yl)propyl)isoindoline-1,3-dione |
| 86 | 198 | (R)-6'-hydroxy-2',4',6'-trimethyl-3'-((4-nitrophenoxy)methyl)spiro[cyclopropane-1,5'-inden]-7'(6'H)-one |
| 87 | 199 | (R)-6'-hydroxy-2',4',6'-trimethyl-3'-(phenoxymethyl)spiro[cyclopropane-1,5'-inden]-7'(6'H)-one |
| 88 | 200 | (R)-6'-hydroxy-3'-(2-hydroxybenzyl)-2',4',6'-trimethylspiro[cyclopropane-1,5'-inden]-7'(6'H)-one |
| 89 | 201 | (R)-N-(3-(6'-hydroxy-2',4',6'-trimethyl-7'-oxo-6',7'-dihydrospiro[cyclopropane-1,5'-inden]-3'-yl)propyl)acetamide |
| 90 | 202 | (S)-N-(3-((R)-6'-hydroxy-2',4',6'-trimethyl-7'-oxo-6',7'-dihydrospiro[cyclopropane-1,5'-inden]-3'-yl)propyl)pyrrolidine-2-carboxamide |
| 91 | 203 | 3-((R)-6'-hydroxy-2',4',6'-trimethyl-7'-oxo-6',7'-dihydrospiro[cyclopropane-1,5'-inden]-3'-yl)propyl L-seryl-L-prolinate |
| 92 | 204 | 2'-(((tert-butyldimethylsilyl)oxy)methyl)-3',6'-dihydroxy-2',4',6'-trimethyl-2',3'-dihydrospiro[cyclopropane-1,5'-inden]-7'(6'H)-one |
| 93 | 205 | (2'R,3'S,6'R)-3'-amino-2'-(((tert-butyldimethylsilyl)oxy)methyl)-6'-hydroxy-2',4',6'-trimethyl-2',3'-dihydrospiro[cyclopropane-1,5'-inden]-7'(6'H)-one |
| 94 | 206 | (2'R,3'S,6'R)-3'-amino-6'-hydroxy-2'-(hydroxymethyl)-2',4',6'-trimethyl-2',3'-dihydrospiro[cyclopropane-1,5'-inden]-7'(6'H)-one |
| 95 | 207 | (S)-2-amino-N-(3-((R)-6'-hydroxy-2',4',6'-trimethyl-7'-oxo-6',7'-dihydrospiro[cyclopropane-1,5'-inden]-3'-yl)propyl)-4-methylpentanamide |
| 96 | 208 | 3-((R)-6'-hydroxy-2',4',6'-trimethyl-7'-oxo-6',7'-dihydrospiro[cyclopropane-1,5'-inden]-3'-yl)propyl (tert-butoxycarbonyl)-L-seryl-L-prolinate |
| 97 | 209 | 3-((R)-6'-hydroxy-2',4',6'-trimethyl-7'-oxo-6',7'-dihydrospiro[cyclopropane-1,5'-inden]-3'-yl)propyl L-seryl-L-seryl-L-prolinate |
| 98 | 210 | 3-((R)-6'-hydroxy-2',4',6'-trimethyl-7'-oxo-6',7'-dihydrospiro[cyclopropane-1,5'-inden]-3'-yl)propyl ((S)-2-((S)-2-((S)-2-((2S,4R)-1-acetyl-4-hydroxypyrrolidine-2-carboxamido)-3-hydroxypropanamido)-3-hydroxypropanamido)-2-cyclohexylacetyl)-L-glutaminyl-L-seryl-L-seryl-L-prolinate |
| 99 | 212 | (3'S,6'R)-6'-hydroxy-2',2',4',6'-tetramethyl-7'-oxo-2',3',6',7'-tetrahydrospiro[cyclopropane-1,5'-inden]-3'-yl L-prolinate |
| 100 | 213 | (2'S,3'R,6'R)-2'-(((tert-butyldimethylsilyl)oxy)methyl)-6'-hydroxy-2',4',6'-trimethyl-7'-oxo-2',3',6',7'-tetrahydrospiro[cyclopropane-1,5'-inden]-3'-yl L-prolinate |
| 101 | 214 | (2'S,3'R,6'R)-2'-(((tert-butyldimethylsilyl)oxy)methyl)-6'-hydroxy-2',4',6'-trimethyl-7'-oxo-2',3',6',7'-tetrahydrospiro[cyclopropane-1,5'-inden]-3'-yl L-seryl-L-prolinate |
| 102 | 215 | (2'S,3'R,6'R)-2'-(((tert-butyldimethylsilyl)oxy)methyl)-6'-hydroxy-2',4',6'-trimethyl-7'-oxo-2',3',6',7'-tetrahydrospiro[cyclopropane-1,5'-inden]-3'-yl ((S)-2-((S)-2-((S)-2-((2S,4R)-1-acetyl-4-hydroxypyrrolidine-2-carboxamido)-3-hydroxypropanamido)-3-hydroxypropanamido)-2-cyclohexylacetyl)-L-glutaminyl-L-seryl-L-prolinate |
| 103 | 216 | (3'S,6'R)-6'-hydroxy-2',2',4',6'-tetramethyl-7'-oxo-2',3',6',7'-tetrahydrospiro[cyclopropane-1,5'-inden]-3'-yl (S)-2-((S)-2-((S)-2-((2S,4R)-1-acetyl-4-hydroxypyrrolidine-2-carboxamido)-3-hydroxypropanamido)-2-cyclohexylacetyl)-L-glutaminyl-L-seryl-L-seryl-L-prolinate |
| 104 | 217 | (R)-(6'-hydroxy-2',4',6'-trimethyl-7'-oxo-6',7'-dihydrospiro[cyclopropane-1,5'-inden]-3'-yl)methyl 6-(2,5-dioxo-2,5-dihydro-1H-pyrrol-1-yl)hexanoate |
| 105 | 218 | (3'S,6'R)-6'-hydroxy-2',2',4',6'-tetramethyl-7'-oxo-2',3',6',7'-tetrahydrospiro[cyclopropane-1,5'-inden]-3'-yl 6-(2,5-dioxo-2,5-dihydro-1H-pyrrol-1-yl)hexanoate |
| 106 | 219 | (2'S,3'R,6'R)-2'-(((tert-butyldimethylsilyl)oxy)methyl)-6'-hydroxy-2',4',6'-trimethyl-7'-oxo-2',3',6',7'-tetrahydrospiro[cyclopropane-1,5'-inden]-3'-yl 4-(fluorosulfonyl)benzoate |
| 107 | 221 | (S)-2-((3S,6S,9S,12S,15S)-3-((1H-imidazol-4-yl)methyl)-12-(4-aminobutyl)-6,9-bis(hydroxymethyl)-15-isobutyl-1-morpholino-1,4,7,10,13-pentaoxo-2,5,8,11,14-pentaazahexadecan-16-amido)-N1-((S)-1-((3-((R)-6'-hydroxy-2',4',6'-trimethyl-7'-oxo-6',7'-dihydrospiro[cyclopropane-1,5'-inden]-3'-yl)propyl)amino)-4-methyl-1-oxopentan-2-yl)pentanediamide |
| 108 | 222 | (3'S,6'R)-6'-hydroxy-2',2',4',6'-tetramethyl-7'-oxo-2',3',6',7'-tetrahydrospiro[cyclopropane-1,5'-inden]-3'-yl 4-(fluorosulfonyl)benzoate |
| 109 | 223 | 3-((R)-6'-hydroxy-2',4',6'-trimethyl-7'-oxo-6',7'-dihydrospiro[cyclopropane-1,5'-inden]-3'-yl)propyl ((4R,7S,13S)-13-(2-amino-2-oxoethyl)-7-(3-guanidinopropyl)-6,9,12,15-tetraoxo-1,2-dithia-5,8,14-triazacycloheptadecane-4-carbonyl)glycinate |

| Analog | | IUPAC Name of Illudofulvene Analog |
|---|---|---|
| 110 | 224 | (R,E)-6'-hydroxy-2',4',6'-trimethylspiro[cyclopropane-1,5'-inden]-7'(6'H)-one oxime |
| 111 | 225 | (2'R,3'R,6'R,E)-2',3',6'-trihydroxy-2',4',6'-trimethyl-2',3'-dihydrospiro[cyclopropane-1,5'-inden]-7'(6'H)-one oxime |
| 112 | 226 | (R)-(6'-hydroxy-2',4',6'-trimethyl-7'-oxo-6',7'-dihydrospiro[cyclopropane-1,5'-inden]-3'-yl)methyl (E)-octadec-9-enoate |
| 113 | 227 | (R)-3-(6'-hydroxy-2',4',6'-trimethyl-7'-oxo-6',7'-dihydrospiro[cyclopropane-1,5'-inden]-3'-yl)propyl (E)-octadec-9-enoate |
| 114 | 228 | (2'S,6'R)-6'-hydroxy-2',4',6'-trimethyl-2'-((((E)-octadec-9-enoyl)oxy)methyl)-7'-oxo-2',3',6',7'-tetrahydrospiro[cyclopropane-1,5'-inden]-3'-yl (E)-octadec-9-enoate |
| 115 | 229 | (R,E)-N-(3-(6'-hydroxy-2',4',6'-trimethyl-7'-oxo-6',7'-dihydrospiro[cyclopropane-1,5'-inden]-3'-yl)propyl)octadec-9-enamide |
| 116 | 230 | N-((3'R,6'R)-6'-hydroxy-2',2',4',6'-tetramethyl-7'-oxo-2',3',6',7'-tetrahydrospiro[cyclopropane-1,5'-inden]-3'-yl)methanesulfonamide |
| 117 | 231 | N-((3'R,6'R)-6'-hydroxy-2',2',4',6'-tetramethyl-7'-oxo-2',3',6',7'-tetrahydrospiro[cyclopropane-1,5'-inden]-3'-yl)-4-methylbenzenesulfonamide |
| 118 | 236 | (R)-6'-hydroxy-3'-(hydroxymethyl)-1',2',4',6'-tetramethylspiro[cyclopropane-1,5'-inden]-7'(6'H)-one |
| 119 | 240 | (R)-3-(6'-hydroxy-2',4',6'-trimethyl-7'-oxo-6',7'-dihydrospiro[cyclopropane-1,5'-inden]-3'-yl)propyl acetoxy(acetyl)carbamate |
| 120 | 249 | (R)-6'-hydroxy-2'-(hydroxymethyl)-3',4',6'-trimethylspiro[cyclopropane-1,5'-inden]-7'(6'H)-one |
| 121 | 250 | ((1a'R,2'S,3'R,6'R,7a'S)-3'-acetoxy-6'-hydroxy-2',4',6'-trimethyl-7'-oxo-1',1a',2',3',6',7'-hexahydrospiro[cyclopropane-1,5'-cyclopropa[c]inden]-2'-yl)methyl acetate |
| 122 | 251 | ((1a'S,2'S,3'S,3'R,6'R,7a'R)-3'-acetoxy-6'-hydroxy-2',4',6'-trimethyl-7'-oxo-1',1a',2',3',6',7'-hexahydrospiro[cyclopropane-1,5'-cyclopropa[c]inden]-2'-yl)methyl acetate |
| 123 | 252 | (1a'R,3'S,6'R,7a'S)-3',6'-dihydroxy-2',2',4',6'-tetramethyl-1',1a',2',3'-tetrahydrospiro[cyclopropane-1,5'-cyclopropa[c]inden]-7'(6'H)-one |
| 124 | 253 | (1a'S,3'S,6'R,7a'R)-3',6'-dihydroxy-2',2',4',6'-tetramethyl-1',1a',2',3'-tetrahydrospiro[cyclopropane-1,5'-cyclopropa[c]inden]-7'(6'H)-one |
| 125 | 254 | (R)-3-(6'-hydroxy-2',4',6'-trimethyl-7'-oxo-6',7'-dihydrospiro[cyclopropane-1,5'-inden]-3'-yl)propyl 4-sulfamoylbenzoate |
| 126 | 255 | (R)-3-(6'-hydroxy-2',4',6'-trimethyl-7'-oxo-6',7'-dihydrospiro[cyclopropane-1,5'-inden]-3'-yl)propyl sulfamate |
| 127 | 256 | 3-((R)-6'-hydroxy-2',4',6'-trimethyl-7'-oxo-6',7'-dihydrospiro[cyclopropane-1,5'-inden]-3'-yl)propyl 1-(3-((R)-6'-hydroxy-2',4',6'-trimethyl-7'-oxo-6',7'-dihydrospiro[cyclopropane-1,5'-inden]-3'-yl)propyl)-1H-1,2,3-triazole-4-carboxylate |
| 128 | 257 | 3-((R)-6'-hydroxy-2',4',6'-trimethyl-7'-oxo-6',7'-dihydrospiro[cyclopropane-1,5'-inden]-3'-yl)propyl 1-((R)-6'-hydroxy-2',4',6'-trimethyl-7'-oxo-6',7'-dihydrospiro[cyclopropane-1,5'-inden]-3'-yl)methyl)-1H-1,2,3-triazole-4-carboxylate |
| 129 | 258 | (4-carboxy-4-(4-carboxy-4-((3-((R)-6'-hydroxy-2',4',6'-trimethyl-7'-oxo-6',7'-dihydrospiro[cyclopropane-1,5'-inden]-3'-yl)propyl)amino)butanamido)butanoyl)glutamic acid |
| 130 | 259 | (R)-3'-((S)-2,2-dioxido-1,2,3-oxathiazinan-4-yl)-6'-hydroxy-2',4',6'-trimethylspiro[cyclopropane-1,5'-inden]-7'(6'H)-one |
| 131 | 262 | methyl (R)-2-(((6'-hydroxy-2',4',6'-trimethyl-7'-oxo-6',7'-dihydrospiro[cyclopropane-1,5'-inden]-3'-yl)methyl)sulfonyl)acetate |
| 132 | 263 | methyl 2-((((R)-6'-hydroxy-2',4',6'-trimethyl-7'-oxo-6',7'-dihydrospiro[cyclopropane-1,5'-inden]-3'-yl)methyl)sulfinyl)acetate |
| 133 | 267 | (R)-2-amino-N-((6'-hydroxy-2',4',6'-trimethyl-7'-oxo-6',7'-dihydrospiro[cyclopropane-1,5'-inden]-3'-yl)methyl)-N-methoxyacetamide |
| 134 | 268 | (R)-2,2,2-trifluoro-N-(3-(6'-hydroxy-2',4',6'-trimethyl-7'-oxo-6',7'-dihydrospiro[cyclopropane-1,5'-inden]-3'-yl)propyl)acetamide |
| 135 | 269 | (R)-(6'-hydroxy-2',4',6'-trimethyl-7'-oxo-6',7'-dihydrospiro[cyclopropane-1,5'-inden]-3'-yl)methyl (4-methoxyphenyl)sulfamate |
| 136 | 270 | (R)-3'-(aminomethyl)-6'-hydroxy-2',4',6'-trimethylspiro[cyclopropane-1,5'-inden]-7'(6'H)-one |
| 137 | 272 | (5S,6S,7S)-3-(((3-((R)-6'-hydroxy-2',4',6'-trimethyl-7'-oxo-6',7'-dihydrospiro[cyclopropane-1,5'-inden]-3'-yl)propanoyl)oxy)methyl)-8-oxo-7-(2-(thiophen-2-yl)acetamido)-5-thia-1-azabicyclo[4.2.0]oct-2-ene-2-carboxylic acid 5-oxide |
| 138 | 273 | (5S,6S,7S)-3-((((3-((R)-6'-hydroxy-2',4',6'-trimethyl-7'-oxo-6',7'-dihydrospiro[cyclopropane-1,5'-inden]-3'-yl)propyl)carbamoyl)oxy)methyl)-8-oxo-7-(2-(thiophen-2-yl)acetamido)-5-thia-1-azabicyclo[4.2.0]oct-2-ene-2-carboxylic acid 5-oxide |
| 139 | 274 | (6S,7S)-3-((((3-((R)-6'-hydroxy-2',4',6'-trimethyl-7'-oxo-6',7'-dihydrospiro[cyclopropane-1,5'-inden]-3'-yl)propyl)carbamoyl)oxy)methyl)-8-oxo-7-(2-(thiophen-2-yl)acetamido)-5-thia-1-azabicyclo[4.2.0]oct-2-ene-2-carboxylic acid 5,5-dioxide |
| 140 | 275 | N-(((R)-6'-hydroxy-2',4',6'-trimethyl-7'-oxo-6',7'-dihydrospiro[cyclopropane-1,5'-inden]-3'-yl)methyl)pyrrolidine-2-carboxamide |
| 141 | 276 | 2-amino-N-(((R)-6'-hydroxy-2',4',6'-trimethyl-7'-oxo-6',7'-dihydrospiro[cyclopropane-1,5'-inden]-3'-yl)methyl)-4-methylpentanamide |
| 142 | 284 | (R)-3-((6'-hydroxy-2',4',6'-trimethyl-7'-oxo-6',7'-dihydrospiro[cyclopropane-1,5'-inden]-3'-yl)methyl)pyrimidine-2,4(1H,3H)-dione |
| 143 | 285 | N-hydroxy-N-[(6'-hydroxy-2',6'-dimethyl-7'-oxo-6',7'-dihydrospiro[cyclopropane-1,5'-inden]-3'-yl)methyl]sulfuric diamide |
| 144 | 286 | (R)-5-fluoro-1-((6'-hydroxy-2',4',6'-trimethyl-7'-oxo-6',7'-dihydrospiro[cyclopropane-1,5'-inden]-3'-yl)methyl)pyrimidine-2,4(1H,3H)-dione |
| 145 | 287 | (R)-5-fluoro-3-((6'-hydroxy-2',4',6'-trimethyl-7'-oxo-6',7'-dihydrospiro[cyclopropane-1,5'-inden]-3'-yl)methyl)pyrimidine-2,4(1H,3H)-dione |
| 146 | 289 | (R)-1-((6'-hydroxy-2',4',6'-trimethyl-7'-oxo-6',7'-dihydrospiro[cyclopropane-1,5'-inden]-3'-yl)methyl)pyrimidine-2,4(1H,3H)-dione |
| 147 | 290 | ((S)-6'-hydroxy-2',4',6'-trimethyl-7'-oxo-6',7'-dihydrospiro[cyclopropane-1,5'-inden]-3'-yl)methyl 5-oxo-5-(((S)-1,2,3,10-tetramethoxy-9-oxo-5,6,7,9-tetrahydrobenzo[a]heptalen-7-yl)amino)pentanoate |
| 148 | 291 | 3-((S)-6'-hydroxy-2',4',6'-trimethyl-7'-oxo-6',7'-dihydrospiro[cyclopropane-1,5'-inden]-3'-yl)propyl 5-oxo-5-(((S)-1,2,3,10-tetramethoxy-9-oxo-5,6,7,9-tetrahydrobenzo[a]heptalen-7-yl)amino)pentanoate |
| 149 | 292 | N1-(((S)-6'-hydroxy-2',4',6'-trimethyl-7'-oxo-6',7'-dihydrospiro[cyclopropane-1,5'-inden]-3'-yl)methyl)-N5-((S)-1,2,3,10-tetramethoxy-9-oxo-5,6,7,9-tetrahydrobenzo[a]heptalen-7-yl)glutaramide |
| 150 | 293 | 3-((S)-6'-hydroxy-2',4',6'-trimethyl-7'-oxo-6',7'-dihydrospiro[cyclopropane-1,5'-inden]-3'-yl)-N-((S)-1,2,3,10-tetramethoxy-9-oxo-5,6,7,9-tetrahydrobenzo[a]heptalen-7-yl)propanamide |

-continued

| | Analog | IUPAC Name of Illudofulvene Analog |
|---|---|---|
| 151 | 294 | 2-amino-N-(((R)-6'-hydroxy-2',4',6'-trimethyl-7'-oxo-6',7'-dihydrospiro[cyclopropane-1,5'-inden]-3'-yl)methyl)-N-methoxypropanamide |
| 152 | 295 | 2-amino-N-(((R)-6'-hydroxy-2',4',6'-trimethyl-7'-oxo-6',7'-dihydrospiro[cyclopropane-1,5'-inden]-3'-yl)methyl)-N-methoxy-4-methylpentanamide |
| 153 | 296 | 2-amino-N-(((R)-6'-hydroxy-2',4',6'-trimethyl-7'-oxo-6',7'-dihydrospiro[cyclopropane-1,5'-inden]-3'-yl)methyl)-N-methoxy-4-(methylthio)butanamide |
| 154 | 297 | 2-amino-N-(((R)-6'-hydroxy-2',4',6'-trimethyl-7'-oxo-6',7'-dihydrospiro[cyclopropane-1,5'-inden]-3'-yl)methyl)-3-(1H-indol-3-yl)-N-methoxypropanamide |
| 155 | 298 | (R)-3-(6'-hydroxy-2',4',6'-trimethyl-7'-oxo-6',7'-dihydrospiro[cyclopropane-1,5'-inden]-3'-yl)propyl (tert-butoxycarbonyl)glycinate |
| 156 | 299 | (2'S,3'R,6'R)-2'-(azidomethyl)-3',6'-dihydroxy-2',4',6'-trimethyl-2',3'-dihydrospiro[cyclopropane-1,5'-inden]-7'(6'H)-one |
| 157 | 300 | (2'R,3'R,6'R)-3'-azido-6'-hydroxy-2'-(hydroxymethyl)-2',4',6'-trimethyl-2',3'-dihydrospiro[cyclopropane-1,5'-inden]-7'(6'H)-one |
| 158 | 301 | (R)-6'-hydroxy-2',4',6'-trimethyl-7'-oxo-6',7'-dihydrospiro[cyclopropane-1,5'-inden]-3'-yl 6-oxo-6-phenylhexanoate |
| 159 | 302 | ((2'S,3'R,6'R)-3',6'-dihydroxy-2',4',6'-trimethyl-7'-oxo-2',3',6',7'-tetrahydrospiro[cyclopropane-1,5'-inden]-2'-yl)methyl 3,5-dinitrobenzoate |
| 160 | 303 | (2'S,3'R,6'R)-2'-(((3,5-dinitrocyclohexa-2,4-diene-1-carbonyl)oxy)methyl)-6'-hydroxy-2',4',6'-trimethyl-7'-oxo-2',3',6',7'-tetrahydrospiro[cyclopropane-1,5'-inden]-3'-yl 3,5-dinitrobenzoate |
| 161 | 304 | (R)-3-(6'-hydroxy-2',4',6'-trimethyl-7'-oxo-6',7'-dihydrospiro[cyclopropane-1,5'-inden]-3'-yl)propyl propiolate |
| 162 | 305 | (R)-3-(6'-hydroxy-2',4',6'-trimethyl-7'-oxo-6',7'-dihydrospiro[cyclopropane-1,5'-inden]-3'-yl)propyl (4-nitrophenyl) carbonate |
| 163 | 306 | (R)-3-(6'-hydroxy-2',4',6'-trimethyl-7'-oxo-6',7'-dihydrospiro[cyclopropane-1,5'-inden]-3'-yl)propyl 4-methylbenzenesulfonate |
| 164 | 307 | (3'R,6'R)-3'-azido-6'-hydroxy-2',2',4',6'-tetramethyl-2',3'-dihydrospiro[cyclopropane-1,5'-inden]-7'(6'H)-one |
| 165 | 308 | (3'R,6'R)-3'-amino-6'-hydroxy-2',2',4',6'-tetramethyl-2',3'-dihydrospiro[cyclopropane-1,5'-inden]-7'(6'H)-one |
| 166 | 309 | (2'R,3'S,6'R)-3'-azido-2'-(((tert-butyldimethylsilyl)oxy)methyl)-6'-hydroxy-2',4',6'-trimethyl-2',3'-dihydrospiro[cyclopropane-1,5'-inden]-7'(6'H)-one |
| 167 | 310 | (R)-(6'-hydroxy-2',4',6'-trimethyl-7'-oxo-6',7'-dihydrospiro[cyclopropane-1,5'-inden]-3'-yl)methyl 4-sulfamoylbenzoate |
| 168 | 311 | (3'S,6'R)-6'-hydroxy-2',2',4',6'-tetramethyl-7'-oxo-2',3',6',7'-tetrahydrospiro[cyclopropane-1,5'-inden]-3'-yl 4-sulfamoylbenzoate |
| 169 | 312 | (R)-(6'-hydroxy-2',4',6'-trimethyl-7'-oxo-6',7'-dihydrospiro[cyclopropane-1,5'-inden]-3'-yl)methyl 4-methylbenzenesulfonate |
| 170 | 313 | 2,3,4,5,6-pentafluoro-N-((3'R,6'R)-6'-hydroxy-2',2',4',6'-tetramethyl-7'-oxo-2',3',6',7'-tetrahydrospiro[cyclopropane-1,5'-inden]-3'-yl)benzenesulfonamide |
| 171 | 314 | (R)-3-(6'-hydroxy-2',4',6'-trimethyl-7'-oxo-6',7'-dihydrospiro[cyclopropane-1,5'-inden]-3'-yl)propyl 4-methylbenzenesulfonate |
| 172 | 315 | (R)-3'-((2,5-dimethyl-1H-pyrrol-3-yl)methyl)-6'-hydroxy-2',4',6'-trimethylspiro[cyclopropane-1,5'-inden]-7'(6'H)-one |
| 173 | 316 | ((2'S,3'R,6'R)-3',6'-dihydroxy-2',4',6'-trimethyl-7'-oxo-2',3',6',7'-tetrahydrospiro[cyclopropane-1,5'-inden]-2'-yl)methyl 4-(fluorosulfonyl)benzoate |

Table XII shows previously identified Illudin analogs.

| # | Analog | IUPAC Name of Illudofulvene Analog |
|---|---|---|
| 1 | 001 | (R)-6'-hydroxy-2',4',6'-trimethylspiro[cyclopropane-1,5'-inden]-7'(6'H)-one |
| 2 | 002 | (6'R)-6'-hydroxy-3'-(hydroxymethyl)-2',4',6'-trimethylspiro[cyclopropane-1,5'-inden]-7'(6'H)-one |
| 3 | 003 | (6'R,6'''R)-3',3'''-methylenebis(6'-hydroxy-2',4',6'-trimethylspiro[cyclopropane-1,5'-inden]-7'(6'H)-one) |
| 4 | 004 | (R)-3'-bromo-6'-hydroxy-2',4',6'-trimethylspiro[cyclopropane-1,5'-inden]-7'(6'H)-one |
| 5 | 005 | (R)-6'-hydroxy-3'-iodo-2',4',6'-trimethylspiro[cyclopropane-1,5'-inden]-7'(6'H)-one |
| 6 | 006 | (R)-6'-hydroxy-3'-(4-hydroxybenzyl)-2',4',6'-trimethylspiro[cyclopropane-1,5'-inden]-7'(6'H)-one |
| 7 | 007 | (R)-6'-hydroxy-3'-(4-methoxybenzyl)-2',4',6'-trimethylspiro[cyclopropane-1,5'-inden]-7'(6'H)-one |
| 8 | 008 | (R)-((6'-hydroxy-2',4',6'-trimethyl-7'-oxo-6',7'-dihydrospiro[cyclopropane-1,5'-inden]-3'-yl)methoxy)methyl acetate |
| 9 | 009 | (R)-6'-hydroxy-3'-(3-hydroxypropyl)-2',4',6'-trimethylspiro[cyclopropane-1,5'-inden]-7'(6'H)-one |
| 10 | 010 | (R)-3-(6'-hydroxy-2',4',6'-trimethyl-7'-oxo-6',7'-dihydrospiro[cyclopropane-1,5'-inden]-3'-yl)propanal |
| 11 | 011 | (R)-6'-hydroxy-2',4',6'-trimethyl-7'-oxo-6',7'-dihydrospiro[cyclopropane-1,5'-indene]-3'-carbaldehyde |
| 12 | 012 | (R)-6'-hydroxy-2',4',6'-trimethyl-3'-nitrospiro[cyclopropane-1,5'-inden]-7'(6'H)-one |
| 13 | 013 | 4-hydroxy-5-(((R)-6'-hydroxy-2',4',6'-trimethyl-7'-oxo-6',7'-dihydrospiro[cyclopropane-1,5'-inden]-3'-yl)methyl)cyclohexane-1,3-dicarbaldehyde |
| 14 | 014 | (4a'S,7'R,9b'S)-7'-hydroxy-4a',7',9'-trimethyl-4a',9b'-dihydro-4'H-spiro[cyclopropane-1,8'-indeno[1,2-d][1,3]dioxin]-6'(7'H)-one |
| 15 | 015 | (R)-3'-(hydroxymethyl)-2',4',6'-trimethyl-7'-oxo-6',7'-dihydrospiro[cyclopropane-1,5'-inden]-6'-yl acetate |
| 16 | 016 | (R)-3'-(ethoxymethyl)-6'-hydroxy-2',4',6'-trimethylspiro[cyclopropane-1,5'-inden]-7'(6'H)-one |
| 17 | 017 | (6'R,6R)-3',3'''-(oxybis(methylene))bis(6'-hydroxy-2',4',6'-trimethylspiro[cyclopropane-1,5'-inden]-7'(6'H)-one) |
| 18 | 018 | (R)-6'-hydroxy-2',4',6'-trimethyl-3'-((((2R,3S,4R,5R,6S)-3,4,5-trihydroxy-6-(hydroxymethyl)tetrahydro-2H-pyran-2-yl)oxy)methyl)spiro[cyclopropane-1,5'-inden]-7'(6'H)-one |
| 19 | 019 | (6'R)-3'4(2,3-dihydroxypropoxy)methyl)-6'-hydroxy-2',4',6'-trimethylspiro[cyclopropane-1,5'-inden]-7'(6'H)-one |
| 20 | 020 | (R)-3'-((2-bromoethoxy)methyl)-6'-hydroxy-2',4',6'-trimethylspiro[cyclopropane-1,5'-inden]-7'(6'H)-one |
| 21 | 021 | (R)-6'-hydroxy-3'-(((2-methoxypropan-2-yl)oxy)methyl)-2',4',6'-trimethylspiro[cyclopropane-1,5'-inden]-7'(6'H)-one |
| 22 | 022 | (R)-6'-hydroxy-3'-((2-hydroxyethoxy)methyl)-2',4',6'-trimethylspiro[cyclopropane-1,5'-inden]-7'(6'H)-one |
| 23 | 023 | (R)-6'-hydroxy-3'-(((4-hydroxyphenylethio)methyl)-2',4',6'-trimethylspiro[cyclopropane-1,5'-inden]-7'(6'H)-one |
| 24 | 024 | (R)-3'-((benzylthio)methyl)-6'-hydroxy-2',4',6'-trimethylspiro[cyclopropane-1,5'-inden]-7'(6'H)-one |
| 25 | 025 | methyl (R)-2-(((6'-hydroxy-2',4',6'-trimethyl-7'-oxo-6',7'-dihydrospiro[cyclopropane-1,5'-inden]-3'-yl)methyl)thio)acetate |

-continued

| # | Analog | IUPAC Name of Illudofulvene Analog |
|---|---|---|
| 26 | 026 | (R)-6'-hydroxy-2',4',6'-trimethyl-3'-((p-tolylthio)methyl)spiro[cyclopropane-1,5'-inden]-7'(6'H)-one |
| 27 | 027 | (R)-(6'-hydroxy-2',4',6'-trimethyl-7'-oxo-6',7'-dihydrospiro[cyclopropane-1,5'-inden]-3'-yl)methyl phenyl carbonate |
| 28 | 028 | (R)-(6'-hydroxy-2',4',6'-trimethyl-7'-oxo-6',7'-dihydrospiro[cyclopropane-1,5'-inden]-3'-yl)methyl benzoate |
| 29 | 029 | (R)-2-(((6'-hydroxy-2',4',6'-trimethyl-7'-oxo-6',7'-dihydrospiro[cyclopropane-1,5'-inden]-3'-yl)methyl)thio)acetic acid |
| 30 | 030 | methyl (R)-2-(((6'-hydroxy-1'-((2-methoxy-2-oxoethyl)thio)-2',4',6'-trimethyl-7'-oxo-6',7'-dihydrospiro[cyclopropane-1,5'-inden]-3'-yl)methyl)thio)acetate |
| 31 | 031 | methyl 2-(((((6'R)-6',7a'-dihydroxy-1'-((2-methoxy-2-oxoethyl)thio)-2',4',6'-trimethyl-7'-oxo-1',6,7',7a'-tetrahydrospiro[cyclopropane-1,5'-inden]-3'-yl)methypthio)acetate |
| 32 | 032 | (6'R)-3'-(((2,3-dihydroxypropyl)thio)methyl)-6'-hydroxy-2',4',6'-trimethylspiro[cyclopropane-1,5'-inden]-7'(6'H)-one |
| 33 | 033 | 7'-methyl-4'H-dispiro[cyclopropane-1,6'-indene-5',2''-[1,3]dioxolan]-4'-one |
| 34 | 034 | (R)-(6'-hydroxy-2',4',6'-trimethyl-7'-oxo-6',7'-dihydrospiro[cyclopropane-1,5'-inden]-3'-yl)methyl acetate |
| 35 | 035 | 6'-hydroxy-4'-methylspiro[cyclopropane-1,5'-inden]-7'(6'H)-one |
| 36 | 036 | (R)-3'-((1H-imidazol-1-yl)methyl)-6'-hydroxy-2',4',6'-trimethylspiro[cyclopropane-1,5'-inden]-7'(6'H)-one |
| 37 | 037 | 1-carboxy-2-((((R)-6'-hydroxy-2',4',6'-trimethyl-7'-oxo-6',7'-dihydrospiro[cyclopropane-1,5'-inden]-3'-yl)methyl)thio)ethan-1-aminium |
| 38 | 038 | (R)-3-(6'-hydroxy-2',4',6'-trimethyl-7'-oxo-6',7'-dihydrospiro[cyclopropane-1,5'-inden]-3'-yl)propanoic acid |
| 39 | 039 | (R)-3'-(3,3-dimethoxypropyl)-6'-hydroxy-2',4',6'-trimethylspiro[cyclopropane-1,5'-inden]-7'(6'H)-one |
| 40 | 040 | (R)-3'-(3,3-diethoxypropyl)-6'-hydroxy-2',4',6'-trimethylspiro[cyclopropane-1,5'-inden]-7'(6'H)-one |
| 41 | 041 | (R,Z)-3-(6'-hydroxy-2',4',6'-trimethyl-7'-oxo-6',7'-dihydrospiro[cyclopropane-1,5'-inden]-3'-yl)acrylaldehyde |
| 42 | 042 | (R)-3'-(hydroxymethyl)-4',6'-dimethyl-6'-((triethylsilypoxy)spiro[cyclopropane-1,5'-inden]-7'(6'H)-one |
| 43 | 043 | (R)-6'-hydroxy-2',4',6'-trimethyl-3'-(((triethylsilyl)oxy)methyl)spiro[cyclopropane-1,5'-inden]-7'(6'H)-one |
| 44 | 044 | (R)-2',4',6'-trimethyl-6'-((triethylsilyl)oxy)-3'-(((triethylsilyl)oxy)methyl)spiro[cyclopropane-1,5'-inden]-7'(6'H)-one |
| 45 | 045 | methyl 2-((7-hydroxy-5-(2-hydroxymethyl)-3-(hydroxymethyl)-2,4,6-trimethyl-1H-inden-1-yl)thio)acetate |
| 46 | 046 | (R)-3-(6'-hydroxy-2',4',6'-trimethyl-7'-oxo-6',7'-dihydrospiro[cyclopropane-1,5'-inden]-3'-yl)propyl acetate |
| 47 | 047 | (6'R)-3'-(2-(1,7-dihydroxy-2,4,6-trimethyl-1H-inden-5-yl)ethyl)-6'-hydroxy-2',4',6'-trimethylspiro[cyclopropane-1,5'-inden]-7'(6'H)-one |
| 48 | 048 | (R)-6'-hydroxy-2',4',6'-trimethyl-1'-(p-tolylthio)-3'-((p-tolylthio)methyl)spiro[cyclopropane-1,5'-inden]-7'(6'H)-one |
| 49 | 049 | (R)-6'-hydroxy-2',4',6'-trimethyl-3'-(p-tolylthio)spiro[cyclopropane-1,5'-inden]-7'(6'H)-one |
| 50 | 050 | (R)-6'-hydroxy-2',4',6'-trimethyl-1',3'-bis(p-tolylthio)spiro[cyclopropane-1,5'-inden]-7'(6'H)-one |
| 51 | 051 | (R)-2-(2-(((6'-hydroxy-2',4',6'-trimethyl-7'-oxo-6',7'-dihydrospiro[cyclopropane-1,5'-inden]-3'-yl)methyl)thio)acetoxy)ethyl 2-mercaptoacetate |
| 52 | 052 | ethane-1,2-diyl bis(2-((((R)-6'-hydroxy-2',4',6'-trimethyl-7'-oxo-6',7'-dihydrospiro[cyclopropane-1,5'-inden]-3'-yl)methyl)thio)acetate) |
| 53 | 053 | (R)-3'-((2-(2-bromoethoxy)ethoxy)methyl)-6'-hydroxy-2',4',6'-trimethylspiro[cyclopropane-1,5'-inden]-7'(6'H)-one |
| 54 | 054 | (R)-6'-hydroxy-1'-(((R)-6'-hydroxy-2',4',6'-trimethyl-7'-oxo-6',7'-dihydrospiro[cyclopropane-1,5'-inden]-3'-yl)methyl)-3'-(hydroxymethyl)-2',4',6'-trimethylspiro[cyclopropane-1,5'-inden]-7'(6'H)-one |
| 55 | 055 | 5-(2-hydroxyethyl)-1-((4-hydroxyphenyl)thio)-3-(((4-hydroxyphenyl)thio)methyl)-2,4,6-trimethyl-1H-inden-7-ol |
| 56 | 056 | (R)-6'-hydroxy-3'-((4-hydroxyphenyl)thio)-2',4',6'-trimethylspiro[cyclopropane-1,5'-inden]-7'(6'H)-one |
| 57 | 057 | (R)-6'-hydroxy-1'-((4-hydroxyphenyl)thio)-2',4',6'-trimethylspiro[cyclopropane-1,5'-inden]-7'(6'H)-one |
| 58 | 058 | (R)-6'-hydroxy-1',3'-bis((4-hydroxyphenyl)thio)-2',4',6'-trimethylspiro[cyclopropane-1,5'-inden]-7'(6'H)-one |
| 59 | 059 | (6'S,7'R)-4'-methyl-6'-((triethylsilypoxy)-6',7'-dihydrospiro[cyclopropane-1,5'-inden]-7'-ol |
| 60 | 060 | (R)-7'-methyl-4'H-dispiro[cyclopropane-1,6'-indene-5',2''-[1,3]dioxolan]-4'-ol |
| 61 | 061 | (S)-4'-methyl-6'-((triethylsilyl)oxy)spiro[cyclopropane-1,5'-inden]-7'(6'H)-one |
| 62 | 062 | (R)-6'-hydroxy-2'-(hydroxymethyl)-4',6'-dimethylspiro[cyclopropane-1,5'-inden]-7'(6'H)-one |
| 63 | 063 | (R)-6'-hydroxy-2',3'-bis(hydroxymethyl)-4',6'-dimethylspiro[cyclopropane-1,5'-inden]-7'(6'H)-one |
| 64 | 064 | N-acetyl-S-(((R)-6'-hydroxy-2',4',6'-trimethyl-7'-oxo-6',7'-dihydrospiro[cyclopropane-1,5'-inden]-3'-yl)methyl)-L-cysteine |
| 65 | 065 | (R)-2-acetamido-3-((((R)-6'-hydroxy-4',6'-dimethyl-7'-oxo-6',7'-dihydrospiro[cyclopropane-1,5'-inden]-3'-yl)methyl)thio)-N-((S)-1-phenylethyl)propanamide |
| 66 | 066 | (S)-2-acetamido-3-((((R)-6'-hydroxy-2',4',6'-trimethyl-7'-oxo-6',7'-dihydrospiro[cyclopropane-1,5'-inden]-3'-yl)methyl)thio)-N-((S)-1-phenylethyl)propanamide |
| 67 | 067 | 4-methyl-2,3-dihydro-5H-indeno[5,6-b]furan-5-one |
| 68 | 068 | 5-hydroxy-6-(2-hydroxyethyl)-7-methyl-1H-inden-1-one |
| 69 | 069 | 5-(2-hydroxyethoxy)-6-(2-hydroxyethyl)-7-methyl-1H-inden-1-one |
| 70 | 070 | (3a'R,4'R)-4'-hydroxy-7'-methyl-3a',4'-dihydro-1'H-dispiro[cyclopropane-1,6'-indene-5',2''-[1,3]dioxolan]-1'-one |
| 71 | 071 | (3a'R,4'R)-7'-methyl-4'-((triethylsilyl)oxy)-3a',4'-dihydro-1'H-dispiro[cyclopropane-1,6'-indene-5',2''-[1,3]dioxolan]-1'-one |
| 72 | 072 | (7'R,7a'R)-7'-hydroxy-4'-methyl-7',7a'-dihydrospiro[cyclopropane-1,5'-indene]-3',6'-dione |
| 73 | 073 | (7'R,7a'R)-4'-methyl-7'-((triethylsilyl)oxy)-7',7a'-dihydrospiro[cyclopropane-1,5'-indene]-3',6'-dione |
| 74 | 074 | (6'R)-3'-((((2,2-dimethyl-1,3-dioxolan-4-yl)methypthio)methyl)-6'-hydroxy-2',4',6'-trimethylspiro[cyclopropane-1,5'-inden]-7'(6'H)-one |
| 75 | 075 | (R)-(6'-hydroxy-4',6'-dimethyl-7'-oxo-6',7'-dihydrospiro[cyclopropane-1,5'-inden]-2'-yl)methyl acetate |
| 76 | 076 | (R)-(6'-hydroxy-4',6'-dimethyl-7'-oxo-6',7'-dihydrospiro[cyclopropane-1,5'-indene]-2',3'-diyl)bis(methylene) diacetate |
| 77 | 077 | (R)-(6'-hydroxy-3'-(hydroxymethyl)-4',6'-dimethyl-7'-oxo-6',7'-dihydrospiro[cyclopropane-1,5'-inden]-2'-yl)methyl acetate |

| # | Analog | IUPAC Name of Illudofulvene Analog |
|---|---|---|
| 78 | 078 | (R)-(6'-hydroxy-2'-(hydroxymethyl)-4',6'-dimethyl-7'-oxo-6',7'-dihydrospiro[cyclopropane-1,5'-inden]-3-yl)methyl acetate |
| 79 | 079 | (R)-6'-hydroxy-2'-(methoxymethyl)-4',6'-dimethylspiro[cyclopropane-1,5'-inden]-7'(6'H)-one |
| 80 | 080 | (R)-6'-hydroxy-3'-(methoxymethyl)-2',4',6'-trimethylspiro[cyclopropane-1,5'-inden]-7'(6'H)-one |
| 81 | 081 | (R)-6'-hydroxy-2'-(hydroxymethyl)-3'-(methoxymethyl)-4,6-dimethylspiro[cyclopropane-1,5'-inden]-7'(6'H)-one |
| 82 | 082 | (R)-6'-hydroxy-2',3'-bis(methoxymethyl)-4',6'-dimethylspiro[cyclopropane-1,5'-inden]-7'(6'H)-one |
| 83 | 083 | (R)-2-acetamido-3-((((R)-6'-hydroxy-2',4',6'-trimethyl-7'-oxo-6',7'-dihydrospiro[cyclopropane-1,5'-inden]-3-yl)methyl)thio)-N-((S)-1-((2-(((S)-4-methyl-1-oxopentan-2-yl)amino)-2-o xoethyl)amino)-1-oxo-3-phenylpropan-2-yl)propanamide |
| 84 | 084 | (S)-2-((R)-2-acetamido-3-((((R)-6'-hydroxy-2',4',6'-trimethyl-7'-oxo-6',7'-dihydrospiro[cyclopropane-1,5'-inden]-3-yl)methyl)thio)propanamido)-4-methyl-N-(2-oxo-2-(((R)-1-oxo-3-phenylpropan-2-yl)amino)ethyl)pentanamide |
| 85 | 085 | (S)-2-((R)-2-acetamido-3-((((R)-6'-hydroxy-2',4',6'-trimethyl-7'-oxo-6',7'-dihydrospiro[cyclopropane-1,5'-inden]-3-yl)methyl)thio)propanamido)-4-methyl-N-((S)-4-methyl-1-oxo-1-(((R)-1-oxo-3-phenylpropan-2-yl)amino)pentan-2-yl)pentanamide |
| 86 | 086 | (R)-2-acetamido-3-((((R)-6'-hydroxy-2',4',6'-trimethyl-7'-oxo-6',7'-dihydrospiro[cyclopropane-1,5'-inden]-3-yl)methyl)thio)-N-(2-oxo-2-(((R)-1-oxo-3-phenylpropan-2-yl)amino)ethyl)propanamide |
| 87 | 087 | (S)-2-((R)-2-acetamido-3-((((R)-6'-hydroxy-2',4',6'-trimethyl-7'-oxo-6',7'-dihydrospiro[cyclopropane-1,5'-inden]-3-yl)methyl)thio)propanamido)-4-methyl-N-((R)-4-methyl-1-(((S)-4-methyl-1-oxopentan-2-yl)amino)-1-oxopentan-2-yl)pentanamide |
| 88 | 088 | (R)-(6'-acetoxy-2',4',6'-trimethyl-7'-oxo-6',7'-dihydrospiro[cyclopropane-1,5'-inden]-3'-yl)methyl acetate |
| 89 | 089 | N5-((R)-1-((carboxymethyl)amino)-3-((((R)-6'-hydroxy-2',4',6'-trimethyl-7'-oxo-6',7'-dihydrospiro[cyclopropane-1,5'-inden]-3-yl)methyl)thio)-1-oxopropan-2-yl)-D-glutamine |
| 90 | 090 | (R)-2'-(hydroxymethyl)-4,6-dimethyl-7'-oxo-6',7'-dihydrospiro[cyclopropane-1,5'-inden]-6'-yl acetate |
| 9 | 094 | (R)-3-(6'-hydroxy-2',4',6'-trimethyl-7'-oxo-6',7'-dihydrospiro[cyclopropane-1,5'-inden]-3'-yl)propyl acetate |
| 95 | 095 | (R)-6'-hydroxy-3'-(3-methoxypropyl)-2',4',6'-trimethylspiro[cyclopropane-1,5'-inden]-7'(6'H)-one |
| 96 | 096 | (R)-6'-hydroxy-2',4',6'-trimethyl-3'-(((1-methyl-1H-imidazol-2-yl)thio)methyl)spiro[cyclopropane-1,5'-inden]-7'(6'H)-one |
| 97 | 097 | S-(((R)-6'-hydroxy-2',4',6'-trimethyl-7'-oxo-6',7'-dihydrospiro[cyclopropane-1,5-inden]-3'-yl)methyl)homocysteine |
| 98 | 098 | ((S)-3-((((R)-6'-hydroxy-2',4',6'-trimethyl-7'-oxo-6',7'-dihydrospiro[cyclopropane-1,5'-inden]-3'-yl)methyl)thio)-2-methylpropanoyl)proline |
| 99 | 099 | (2'S,6'R)-6'-hydroxy-2'-(hydroxymethyl)-2',4',6'-trimethylspiro[cyclopropane-1,5'-indene]-3',7'(2'H,6'H)-dione |
| 100 | 100 | S-(((R)-6'-hydroxy-2',4',6'-trimethyl-7'-oxo-6',7'-dihydrospiro[cyclopropane-1,5'-inden]-3'-yl)methyl)-N-S-(((R)-6'-hydroxy-2',4',6'-trimethyl-7'-oxo-6',7'-dihydrospiro[cyclopropane-1,5'-inden]-3'-yl)methyl)cysteinyl-L-asparaginylglycyl-L-arginylcysteine |
| 101 | 101 | S-(((R)-6'-hydroxy-2',4',6'-trimethyl-7'-oxo-6',7'-dihydrospiro[cyclopropane-1,5'-inden]-3'-yl)methyl)-N-S-(((R)-6'-hydroxy-2',4',6'-trimethyl-7'-oxo-6',7'-dihydrospiro[cyclopropane-1,5'-inden]-3'-yl)methyl)cysteinyl-L-arginylglycyl-L-asparaginylcysteine |
| 102 | 102 | S-(((R)-6'-hydroxy-2',4',6'-trimethyl-7'-oxo-6',7'-dihydrospiro[cyclopropane-1,5'-inden]-3'-yl)methyl)cysteinyl-L-asparaginylglycyl-L-arginylcysteine |
| 103 | 103 | (R)-(6'-acetoxy-2'-(hydroxymethyl)-4',6'-dimethyl-7'-oxo-6',7'-dihydrospiro[cyclopropane-1,5'-inden]-3'-yl)methyl acetate |
| 104 | 104 | (R)-8'-hydroxy-6',8'-dimethyl-1',5'-dihydrospiro[cyclopropane-1,7'-indeno[1,2-e][1,3]dioxepin]-9'(8'H)-one |
| 105 | 105 | (E)-2-((2R,4S)-4-hydroxy-2-((1R,2S)-2-hydroxy-4,4-dimethylcyclopentyl)-2-methylcyclobutylidene)propanal |
| 106 | 132 | (E)-7-(chloromethylene)-5-hydroxy-5,9-dimethylspiro[3.5]non-8-en-6-one |
| 107 | 170 | 5-(2-hydroxyethyl)-3-(hydroxymethyl)-2,4,6-trimethyl-1H-inden-7-ol |
| 108 | 176 | 3-((R)-6'-hydroxy-2',4',6'-trimethyl-7'-oxo-6',7'-dihydrospiro[cyclopropane-1,5'-inden]-3'-yl)propyl leucinate |
| 109 | 184 | (R)-1-hydroxy-1-((6'-hydroxy-2',4',6'-trimethyl-7'-oxo-6',7'-dihydrospiro[cyclopropane-1,5'-inden]-3'-yl)methyl)urea |
| 110 | 185 | (S)-6'-hydroxy-2',4',6'-trimethylspiro[cyclopropane-1,5'-inden]-7'(6'H)-one |
| 111 | 186 | (6'S,7'R)-6',7'-dihydroxy-2',4',6'-trimethyl-7',7a-dihydrospiro[cyclopropane-1,5'-inden]-3'(6'H)-one |
| 112 | 187 | (S)-6'-hydroxy-3'-(hydroxymethyl)-2',4',6'-trimethylspiro[cyclopropane-1,5'-inden]-7'(6'H)-one |
| 113 | 211 | (R)-3'-(3-aminopropyl)-6'-hydroxy-2',4',6'-trimethylspiro[cyclopropane-1,5'-inden]-7'(6'H)-one |
| 114 | 220 | (R)-1-acetoxy-1-((6'-hydroxy-2',4',6'-trimethyl-7'-oxo-6',7'-dihydrospiro[cyclopropane-1,5'-inden]-3'-yl)methyl)ur |
| 115 | 232 | (R)-3-(6'-hydroxy-2',4',6'-trimethyl-7'-oxo-6',7'-dihydrospiro[cyclopropane-1,5'-inden]-3'-yl)propyl hydroxycarbamate |
| 116 | 233 | ethyl (R)-hydroxy((6'-hydroxy-2',4',6'-trimethyl-7'-oxo-6',7'-dihydrospiro[cyclopropane-1,5'-inden]-3'-yl)methyl)carbamate |
| 117 | 234 | benzyl (R)-hydroxy((6'-hydroxy-2',4',6'-trimethyl-7'-oxo-6',7'-dihydrospiro[cyclopropane-1,5'-inden]-3'-yl)methyl)carbamate |
| 118 | 235 | tert-butyl (R)-hydroxy((6'-hydroxy-2',4',6'-trimethyl-7'-oxo-6',7'-dihydrospiro[cyclopropane-1,5'-inden]-3'-yl)methyl)carbamate |
| 119 | 237 | (R)-3-(6'-hydroxy-2',4',6'-trimethyl-7'-oxo-6',7'-dihydrospiro[cyclopropane-1,5'-inden]-3'-yl)propyl (2-bromoethyl)carbamate |
| 120 | 238 | (R)-3-(6'-hydroxy-2',4',6'-trimethyl-7'-oxo-6',7'-dihydrospiro[cyclopropane-1,5'-inden]-3'-yl)propyl (2-chloroethyl)carbamate |
| 121 | 239 | (R)-3-(6'-hydroxy-2',4',6'-trimethyl-7'-oxo-6',7'-dihydrospiro[cyclopropane-1,5'-inden]-3'-yl)propyl (2-hydroxyethyl)carbamate |
| 122 | 241 | (R)-N-(3-(6'-hydroxy-2',4',6'-trimethyl-7'-oxo-6',7'-dihydrospiro[cyclopropane-1,5'-inden]-3'-yl)propyl)methanesulfonamide |
| 123 | 242 | (R)-N-(3-(6'-hydroxy-2',4',6'-trimethyl-7'-oxo-6',7'-dihydrospiro[cyclopropane-1,5'-inden]-3'-yl)propyl)-4-methylbenzenesulfonamide |

| # | Analog | IUPAC Name of Illudofulvene Analog |
|---|---|---|
| 124 | 243 | (R)-3-(6'-hydroxy-2',4',6'-trimethyl-7'-oxo-6',7'-dihydrospiro[cyclopropane-1,5'-inden]-3'-yl)propyl (2-fluoroethyl)carbamate |
| 125 | 244 | (R)-1-hydroxy-1-(3-(6'-hydroxy-2',4',6'-trimethyl-7'-oxo-6',7'-dihydrospiro[cyclopropane-1,5'-inden]-3'-yl)propyl)urea |
| 126 | 245 | (R)-1-hydroxy-1-(3-(6'-hydroxy-2',4',6'-trimethyl-7'-oxo-6',7'-dihydrospiro[cyclopropane-1,5'-inden]-3'-yl)propyl)thiourea |
| 127 | 246 | (R)-3-(6'-hydroxy-2',4',6'-trimethyl-7'-oxo-6',7'-dihydrospiro[cyclopropane-1,5'-inden]-3-yl)propyl morpholine-4-carboxylate |
| 128 | 247 | (R)-3-(6'-hydroxy-2',4',6'-trimethyl-7'-oxo-6',7'-dihydrospiro[cyclopropane-1,5'-inden]-3'-yl)propyl morpholine-4-carboxylate |
| 129 | 248 | (R)-3-(6'-hydroxy-2',4',6'-trimethyl-7'-oxo-6',7'-dihydrospiro[cyclopropane-1,5'-inden]-3'-yl)propyl [1,4'-bipiperidinel-1'-carboxylate |
| 130 | 260 | (R)-N-(3-(6'-hydroxy-2',4',6'-trimethyl-7'-oxo-6',7'-dihydrospiro[cyclopropane-1,5'-inden]-3-yl)propyl)-[1,4'-bipiperidine]-1'-carboxamide |
| 131 | 261 | (R)-3-(6'-hydroxy-2',4',6'-trimethyl-7'-oxo-6',7'-dihydrospiro[cyclopropane-1,5'-inden]-3'-yl)propyl 1H-imidazole-1-carboxylate |
| 132 | 264 | N-[3-(6'-hydroxy-2',6'-dimethyl-7'-oxo-6',7'-dihydrospiro[cyclopropane-1,5'-inden]-3'-yl)propyl]sulfuric diamide |
| 133 | 265 | N-hydroxy-N'-[3-(6'-hydroxy-2',6'-dimethyl-7'-oxo-6',7'-dihydrospiro[cyclopropane-1,5'-inden]-3'-yl)propyl]sulfuric diamide |
| 134 | 266 | N-[3-(6'-hydroxy-2',6'-dimethyl-7'-oxo-6',7'-dihydrospiro[cyclopropane-1,5'-inden]-3'-yl)propyl]-N-methoxysulfuric diamide |
| 135 | 271 | (R)-N-((6'-hydroxy-2',4',6'-trimethyl-7'-oxo-6',7'-dihydrospiro[cyclopropane-1,5'-inden]-3'-yl)methyl)methanesulfonamide |
| 136 | 277 | (R)-1-hydroxy-3-((6'-hydroxy-2',4',6'-trimethyl-7'-oxo-6',7'-dihydrospiro[cyclopropane-1,5'-inden]-3'-yl)methyl)urea |
| 137 | 278 | (R)-1-((6'-hydroxy-2',4',6'-trimethyl-7'-oxo-6',7'-dihydrospiro[cyclopropane-1,5'-inden]-3'-yl)methyl)-3-methoxyurea |
| 138 | 279 | (R)-1-((6'-hydroxy-2',4',6'-trimethyl-7'-oxo-6',7'-dihydrospiro[cyclopropane-1,5'-inden]-3'-yl)methyl)-3-(2-hydroxyethyl)urea |
| 139 | 280 | (R)-1-(3-(6'-hydroxy-2',4',6'-trimethyl-7'-oxo-6',7'-dihydrospiro[cyclopropane-1,5'-inden]-3'-yl)propyl)-3-(2-hydroxyethyl)urea |
| 140 | 281 | (R)-1-2-chloroethyl)-3-(3-(6'-hydroxy-2',4',6'-trimethyl-7'-oxo-6',7'-dihydrospiro[cyclopropane-1,5'-inden]-3'-yl)propyl)urea |
| 141 | 282 | (R)-1-(2-chloroethyl)-3-((6'-hydroxy-2',4',6'-trimethyl-7'-oxo-6',7'-dihydrospiro[cyclopropane-1,5'-inden]-3'-yl)methyl)urea |
| 142 | 283 | N-[(6'-hydroxy-2',6'-dimethyl-7'-oxo-6',7'-dihydrospiro[cyclopropane-1,5'-inden]-3'-yl)methyl]sulfuric diamide |
| 143 | 288 | (R)-1-hydroxy-3-(3-(6'-hydroxy-2',4',6'-trimethyl-7'-oxo-6',7'-dihydrospiro[cyclopropane-1,5'-inden]-3'-yl)propyl)urea |

Table XIII. Summary NCI DIP 60 Cell Line Data.

TABLE XIII

Summary NCI DTP 60 Cell Line Data.

| NAME/NSC | Mean GI50 inhibition | Mean TGI cytostatic | Mean LD50 cytotoxic |
|---|---|---|---|
| Pyrrolobenzodiazepines 694501 | 7 nM | 302 nM | >23,000 nM* |
| Maytansine** 153858 | 19 nM | 318 nM | 49,200 nM |
| Fumagillol 642492 | 6,130 nM | 9,850 nM | >50,000 nM |
| Dolstatin-10 376128 | 17 nM | 2,680 nM | >50,000 nM |
| Auristatins 654663 | 1.4 nM | 902** nM | >5,000 nM** |
| Enadiyne 157365 | 2,900 nM | >100,000 nM | >100,000 nM |
| Halichondrin B 609395 | 1.2 nM | 199 nM | >1,000 nM |
| Tubulysin A | 12 nM | 1,318 nM | >10,000 nM |
| Illudin S | 10 nM | 64 nM | 511 nM |
| Illudin M | 3 nM | 20 nM | 912 nM |

TABLE XIV

Mechanisms of Drug Resistance.

| Mechanism of Multi-drug Resistance | Resistance to Syn-Illudins, Syn-illudins, and Acylfulvenes |
|---|---|
| Gp170/MDR1 | No |
| Gp180/MRP | No |
| Topoisomerase I | No |
| Topoisomerase II | No |
| MVP/LRP (vault) | No |
| Thiol content/GST pi | No |
| DNA repair | No |
| Myc expression | No |
| Bcl-2 expression | No |
| BRCA status | No |
| P53 status | No |
| P21 status | No |
| MGMT expression | No |
| Microtubulin alteration | No |

Table XV ability of Illudin, Syn-Illudin & Acylfulvene to inhibit tumor cell growth.

| Analog Number | Mean IC50 value (nM) ± SD, N = 3 unless otherwise indicated | | | |
|---|---|---|---|---|
| | MV522 Target Cell Line | | 8392B Nontarget Cell Line | |
| | 2 hr exposure | 48 hr exposure | 2 hr exposure | 48 hr exposure |
| 001 | 2200 ± 100 | 350 ± 20 | | 830 ± 100 |
| 002 | 110 ± 40 | 70 ± 10 | 26000 ± 4500 | 800 ± 100 |
| 004 | 4200 | 600 | | |
| 008 | 870 ± 90 | 630 ± 80 | 12200 ± 700 | 15100 ± 2200 |
| 009 | 500 ± 30 | 850 ± 180 | 47100 ± 11000 | 43200 ± 2300 |
| 010 | 8900 ± 1500 | 170 ± 60 | 29400 ± 1600 | 14500 ± 1700 |
| 011 | 4900 ± 900 | 1200 (N = 2) | >100000 | 40400 ± 6700 |
| 012 | 5150 ± 1350 | 320 ± 90 | 42200 ± 5000 | 18800 ± 2800 |
| 013 | 5100 ± 700 | 270 ± 130 | 11900 ± 1300 | 4200 ± 400 |
| 014 | 115 ± 30 | 460 ± 120 | 9650 ± 200 | 1100 ± 300 |
| 015 | 1800 ± 200 | 480 ± 110 | 810 ± 260 | 1300 ± 150 |
| 016 | 490 ± 130 | 440 ± 90 | >100000 | 870 ± 60 |
| 017 | 2400 ± 360 | 320 ± 60 | 14700 ± 900 | |
| 018 | 8800 ± 2900 | | 4200 ± 1300 | |
| 019 | 470 ± 60 | 660 ± 80 | >75000 | |
| 020 | 530 ± 140 | 230 ± 10 | 25000 ± 3100 | |
| 021 | 2400 ± 1000 | 930 ± 250 | 34400 ± 9400 | |
| 022 | 700 ± 200 | 680 ± 180 | 31700 ± 1400 | |
| 023 | 2900 ± 1140 | 2750 ± 500 | >138000 | |
| 024 | 1800 ± 200 | 1200 ± 300 | 12800 ± 2100 | |
| 025 | 1300 ± 310 | 1200 ± 100 | >25000 | |
| 030 | | >3000 | | |
| 031 | | >3000 | | |
| 032 | 600 ± 190 | 210 ± 30 | >30000 | |
| 033 | 10000 ± 1100 | 4600 ± 200 | 29900 ± 3300 | |
| 034 | 1400 ± 170 | 490 ± 40 | >100000 | 4400 ± 200 |
| 035 | 5600 ± 600 | | >150000 | |

-continued

| Analog Number | MV522 Target Cell Line 2 hr exposure | MV522 Target Cell Line 48 hr exposure | 8392B Nontarget Cell Line 2 hr exposure | 8392B Nontarget Cell Line 48 hr exposure |
|---|---|---|---|---|
| 037 | 26000 ± 5000 | 29200 ± 2300 | >85000 | |
| 038 | 750 ± 60 | | 24900 ± 8000 | |
| 039 | 1500 ± 240 | 600 ± 40 | 24600 ± 2400 | 820 ± 250 |
| 040 | 3400 ± 360 | 700 ± 90 | 24000 ± 3300 | 5200 ± 470 |
| 060 | 19400 ± 1800 | | 27600 ± 3000 | |
| 062 | 2600 ± 300 | 660 ± 200 | 37100 ± 2300 | |
| 063 | 43000 ± 5700 | 580 ± 250 | | |
| 064 | 28000 ± 4600 | 1200 ± 300 | | |
| 065 | 6200 ± 1100 | 2500 ± 1200 | | |
| 075 | 19600 ± 9700 | | 62000 ± 3600 | |
| 076 | 24000 ± 6100 | | 39500 ± 7200 | |
| 077 | 9200 ± 1200 | | | |
| 078 | 20400 ± 6300 | | >100000 | |
| 079 | 7700 ± 3500 | | >100000 | |
| 080 | 8800 ± 2400 | | >100000 | |
| 081 | >80000 | | >80000 | |
| 082 | 50600 ± 7100 | | >100000 | |
| 083 | | 37200 ± 2900 | | >42000 |
| 084 | | 28200 ± 1400 | | >42000 |
| 085 | >40000 | >40000 | | |
| 086 | | | | |
| 087 | >40000 | 24700 ± 3900 | >40000 | |
| 088 | | | | |
| 089 | 19300 ± 5700 | 15500 ± 2800 | >60000 | |
| 090 | 2500 ± 400 | 2900 ± 400 | 1600 ± 200 | 3800 ± 300 |
| 094 | 800 ± 100 | 210 ± 20 | 9000 ± 1700 | 110 ± 10 |
| 096 | 2700 ± 400 | 6200 ± 600 | >88000 | >3000 |
| 097 | 2900 ± 100 | | >82000 | |
| 098 | 18800 ± 2500 | 4600 ± 250 | >65000 | 11700 ± 1800 |
| 099 | 8400 ± 1100 | 1800 ± 200 | 4000 ± 400 | 300 ± 20 |
| 100 | >10000 | 1700 ± 500 | | |
| 101 | >8000 | >7500 | | |
| 102 | >13000 | 1300 ± 100 | | |
| 103 | 31800 ± 4900 | 5900 ± 400 | 12100 ± 2000 | 2300 ± 200 |
| 104 | 6300 ± 400 | 6000 ± 500 | 36400 ± 6500 | 2700 ± 600 |
| 105 | 7300 ± 1200 | 2100 ± 400 | >100000 | |
| 106 | 5200 ± 1000 | | >83000 | |
| 107 | >50000 | 1600 ± 100 | >50000 | |
| 108 | 12300 ± 2300 | 520 ± 50 | >55000 | 6000 ± 1600 |
| 109 | >50000 | | >50000 | |
| 110 | >55000 | 1400 ± 100 | >55000 | 25300 ± 2100 |
| 111 | 16700 ± 2100 | 11900 ± 2800 | 34600 ± 2100 | 10200 ± 1000 |
| 112 | 10000 ± 2000 | 6700 ± 1200 | 14900 ± 100 | 5200 ± 300 |
| 113 | 85000 ± 700 | 14100 ± 3000 | >93000 | 7800 ± 1000 |
| 114 | 1500 ± 100 | 260 ± 70 | 25100 ± 1000 | 700 ± 100 |
| 115 | 1500 ± 100 | 70 ± 5 | 1600 ± 700 | 630 ± 60 |
| 116 | 400 ± 100 | 1000 ± 50 | 7000 ± 400 | 170 ± 30 |
| 117 | 1100 ± 100 | 100 ± 30 | 7900 ± 1600 | 10 ± 2 |
| 118 | 14000 ± 2000 | 740 ± 120 | 24500 ± 4500 | 2000 ± 400 |
| 119 | 1100 ± 70 | 270 ± 40 | >33000 | >10000 |
| 120 | 2800 ± 900 | 600 ± 100 | 19100 ± 4600 | 510 ± 110 |
| 121 | 300 ± 10 | 90 ± 10 | 15200 ± 6000 | 1300 ± 500 |
| 122 | 6400 ± 300 | 2400 ± 300 | 14500 ± 1200 | 1100 ± 300 |
| 123 | 1900 ± 400 | 600 ± 60 | 450 ± 30 | 2400 ± 500 |
| 124 | 2800 ± 700 | 870 ± 350 | >30000 | 24800 ± 550 |
| 125 | 3700 ± 600 | 1200 ± 200 | 15500 ± 1400 | 600 ± 100 |
| 126 | 2100 ± 500 | 900 ± 100 | >30000 | 330 ± 80 |
| 127 | 870 ± 30 | 340 ± 90 | >30000 | 100 ± 40 |
| 128 | 840 ± 230 | 370 ± 50 | >35000 | 800 ± 70 |
| 129 | >136000 | 19700 ± 1900 | >136000 | 39400 ± 9200 |
| 130 | 700 ± 100 | 130 ± 40 | 27,000 ± 7000 | 4400 ± 500 |
| 133 | 58800 ± 6600 | 15800 ± 2600 | 12200 ± 2300 | 2700 ± 400 |
| 134 | 50000 ± 6000 | 28000 ± 4000 | 43900 ± 5100 | 8500 ± 2000 |
| 135 | 1600 ± 300 | 22 ± 4 | 70 ± 20 | 22 ± 2 |
| 136 | 430 ± 10 | 130 ± 10 | >6200 | 25 ± 2 |
| 137 | 850 ± 110 | 1200 ± 100 | 8500 ± 1200 | 710 ± 60 |
| 138 | 2100 ± 200 | 1000 ± 200 | 5400 ± 200 | 820 ± 230 |
| 139 | 6400 ± 900 | 3400 ± 500 | 11600 ± 900 | 2600 ± 1000 |
| 140 | 17100 ± 5100 | >14000 | 12700 ± 300 | >14000 |
| 141 | 11400 ± 1000 | 3700 ± 800 | 13700 ± 1900 | 1100 ± 140 |
| 142 | 90 ± 10 | 24 ± 7 | 6400 ± 1100 | 80 ± 6 |
| 143 | 43500 ± 11300 | 11400 ± 1800 | 56500 ± 20000 | 3600 ± 700 |
| 146 | 2500 ± 400 | 740 ± 280 | 13,000 ± 1200 | |
| 147 | >76000 | 26100 ± 12900 | >76000 | 43800 ± 3000 |
| 148 | 17100 ± 1100 | 6800 ± 1100 | 61000 ± 11600 | 6700 ± 1600 |
| 149 | 2900 ± 1000 | 1500 500 | 44600 ± 1400 | 4100 ± 900 |
| 150 | 9500 ± 1600 | 1400 ± 400 | 59000 ± 5500 | 10600 ± 800 |
| 151 | 7900 ± 400 | 4200 ± 1500 | 25500 ± 1200 | 6600 ± 2300 |
| 152 | 6400 ± 1200 | 49000 ± 7700 | 9100 ± 100 | |
| 153 | 8700 ± 2700 | 10900 ± 3400 | >90000 | 15800 ± 9600 |
| 154 | >70000 | 61300 ± 10000 | >70000 | 46,700 ± 13100 |
| 155 | 8200 ± 1200 | 3600 ± 400 | 17,000 ± 4000 | 9100 ± 1100 |
| 156 | 7200 ± 500 | 3100 ± 100 | 32,300 ± 9,400 | 5500 ± 1200 |
| 157 | >400,000 | >123,000 | >350,000 | 13100 ± 1600 |
| 158 | >175,000 | >175,000 | >200,000 | 61,000 ± 9,000 |
| 159 | 2700 ± 400 | 120 ± 10 | 13,700 ± 4,200 | <10 nM |
| 160 | 1900 ± 200 | 500 ± 200 | 52,400 ± 17,800 | 3200 ± 1100 |
| 161 | 2800 ± 500 | 3300 ± 700 | 13,800 ± 3,400 | >10,000 |
| 163 | 3500 ± 800 | 820 ± 40 | 18600 ± 800 | 910 ± 100 |
| 164 | 70 ± 10 | 3500 ± 1600 | 130 ± 40 | |
| 165 | 7700 ± 1100 | 290 ± 40 | 11000 ± 3300 | 11000 ± 1000 |
| 166 | 6500 ± 600 | 7200 ± 1900 | 6500 ± 2100 | 6000 ± 1500 |
| 167 | 14800 ± 2200 | | 18500 ± 2300 | |
| 169 | 7100 ± 600 | | 2300 ± 600 | |
| 177 | 7500 ± 800 | 1900 ± 800 | 73000 ± 5000 | 4100 ± 1300 |
| 178 | 21000 ± 4000 | 1000 ± 100 | 32000 ± 9000 | >8000 |
| 180 | 19900 ± 300 | >4000 | 5200 ± 1800 | 660 ± 50 |
| 182 | 99000 ± 12000 | 38000 ± 8200 | 39000 ± 7000 | 18700 ± 2700 |
| 183 | >120,000 | >275,000 | >120,000 | >235,000 |
| 184 | 800 ± 300 | 210 ± 20 | >100,000 | >10000 |
| 185 | 1700 ± 600 | 1900 ± 100 | | |
| 186 | 144000 ± 32000 | 70000 ± 16000 | 79000 ± 24000 | 48000 ± 2000 |
| 187 | 1300 ± 400 | 900 ± 200 | 3200 ± 800 | 3200 ± 700 |
| 189 | 8900 ± 2500 | 6100 ± 2600 | 41,000 ± 3700 | |
| 190 | 19,000 ± 4000 | >9,000 | 56,000 ± 2000 | >9,000 |
| 191 | >140,000 | 49,000 ± 13000 | >140,000 | 15000 ± 4000 |
| 192 | 1,600 ± 200 | 700 ± 100 | 8700 ± 1700 | 200 ± 30 |
| 193 | 1400 ± 400 | 2500 ± 600 | 48,000 ± 7000 | >11,000 |
| 195 | 1400 ± 200 | 390 ± 120 | 21,000 ± 6000 | 4300 ± 1200 |
| 196 | 840 ± 100 | 450 ± 120 | 80,000 ± 5000 | >9,200 |
| 197 | 950 ± 70 | 500 ± 100 | 9500 ± 400 | 11,300 ± 100 |
| 198 | 700 ± 100 | 2800 ± 600 | >8,200 | >82,000 |
| 199 | 4700 ± 600 | 2500 ± 1100 | >93,000 | >9,300 |
| 201 | 360 ± 110 | 260 ± 70 | 13,000 ± 1700 | 26,000 ± 7000 |
| 202 | 1200 ± 100 | 650 ± 100 | >62,000 | >6200 |
| 203 | 760 ± 170 | 940 ± 330 | 48,000 ± 6000 | >5500 |
| 204 | 220 ± 40 | 1600 ± 300 | 4100 ± 800 | 8600 ± 800 |
| 205 | 8400 ± 2200 | 1200 ± 400 | >185,000 | >2,600 |
| 206 | 610 ± 40 | 230 ± 20 | 20,000 ± 1000 | 8200 ± 200 |
| 207 | 570 ± 60 | 410 ± 60 | | |
| 208 | 1200 ± 100 | 930 ± 160 | 25,000 ± 3000 | |
| 209 | 3900 ± 1100 | 610 ± 100 | >90,000 | |
| 210 | 40,000 ± 4000 | 5500 ± 600 | | |
| 211 | 470 ± 120 | 430 ± 100 | 59,000 ± 9000 | |
| 212 | 80 ± 10 | 55 ± 5 | | |
| 213 | 2300 ± 700 | 1700 ± 700 | | |
| 214 | 2900 ± 800 | 360 ± 30 | | |
| 215 | 26,000 ± 3000 | 490 ± 120 | | |
| 216 | 460 ± 60 | 150 ± 40 | | |

| Analog Number | MV522 Target Cell Line 2 hr exposure | MV522 Target Cell Line 48 hr exposure | 8392B Nontarget Cell Line 2 hr exposure | 8392B Nontarget Cell Line 48 hr exposure |
|---|---|---|---|---|
| | Mean IC50 value (nM) ± SD, N = 3 unless otherwise indicated | | | |
| 217 | 2,200 ± 100 | 2,200 ± 100 | 43,000 ± 4,000 | >7,000 |
| 218 | 10,000 ± 3,000 | 600 ± 200 | 15,000 ± 6,000 | 600 ± 100 |
| 219 | >52,000 | >52,00 | >52,000 | >52,000 |
| 220 | 90 ± 10 | 130 ± 10 | 101,000 ± 18,000 | 40,000 ± 3,000 |
| 221 | >21,000 | 2,500 ± 200 | >21,000 | >21,000 |
| 222 | 5,000 ± 100 | 1,100 ± 100 | 9,300 ± 200 | 330 ± 60 |
| 223 | 20,000 ± 3,700 | 2,700 ± 300 | >185,000 | >55,000 |
| 224 | >200,000 | >130,000 | >200,000 | >130,000 |
| 225 | 47,000 ± 4,000 | 55,000 ± 11,000 | >350,000 | 33,000 ± 13,000 |
| 226 | >59,000 | >59,000 | >59,000 | >59,000 |
| 227 | >57,000 | 4,400 ± 700 | >57,000 | 16,000 ± 4,000 |
| 228 | >38,000 | >38,000 | 24,000 ± 3,000 | >38,000 |
| 229 | >56,000 | >2,000 | >56,000 | >2,000 |
| 230 | 620 ± 80 | 100 ± 10 | 38,000 ± 5,000 | 1,000 ± 200 |
| 231 | 1,500 ± 100 | 280 ± 10 | 14,000 ± 4,000 | |
| 232 | 700 ± 100 | 460 ± 60 | 42,000 ± 6,000 | 3,300 ± 600 |
| 233 | 3,200 ± 300 | 350 ± 80 | >150,000 | 2,400 ± 700 |
| 234 | 3,000 ± 300 | 1,100 ± 400 | 24,000 ± 6,000 | 9,000 ± 1,000 |
| 235 | 3,500 ± 400 | 2,200 ± 400 | 49,000 ± 6,000 | 6,500 ± 1,600 |
| 236 | 49,000 ± 11,000 | 29,000 ± 5,000 | 48,000 ± 10,000 | |
| 237 | 1,200 ± 300 | 730 ± 140 | 22,000 ± 1,000 | 6,600 ± 900 |
| 238 | 780 ± 190 | 57 ± 8 | 23,000 ± 2,000 | 4,700 ± 1,200 |
| 239 | 420 ± 60 | 70 ± 20 | 39,000 ± 3,000 | 28,000 ± 4,000 |
| 240 | 2,900 ± 100 | 1,300 ± 200 | >24,000 | 1,300 ± 100 |
| 241 | 560 ± 90 | 110 ± 20 | >28,000 | 18,000 ± 4,000 |
| 242 | 2,400 ± 400 | 580 ± 150 | 18,000 ± 2,000 | 2,900 ± 600 |
| 243 | 2,200 ± 500 | 670 ± 240 | 64,000 ± 10,000 | 26,000 ± 6,000 |
| 244 | 1,600 ± 400 | 150 ± 10 | 87,000 ± 11,000 | 35,000 ± 7,000 |
| 245 | 3,400 ± 1000 | 440 ± 90 | 79,000 ± 7,000 | 14,000 ± 1,700 |
| 246 | 2,800 ± 260 | 1,900 ± 450 | 14,000 ± 2,000 | 6,200 ± 1,300 |
| 247 | 6,100 ± 2,000 | 1,200 ± 250 | 10,000 ± 1,400 | 7,100 ± 1,700 |
| 248 | 830 ± 100 | 200 ± 25 | 23,000 ± 1,000 | 610 ± 120 |
| 249 | 4,100 ± 820 | 420 ± 100 | 18,000 ± 3,500 | 19,000 ± 3,800 |
| 250 | 99,000 ± 21,000 | 137,000 ± 14,000 | >275,000 | 137,000 ± 10,000 |
| 251 | 128,000 ± 4,000 | 51,000 ± 1,000 | >275,000 | 82,000 ± 8,000 |
| 252 | >380,000 | 33,000 ± 3,000 | >380,000 | >380,000 |
| 253 | >380,000 | >38,000 | >380,000 | >380,000 |
| 254 | 2,700 ± 800 | 1,100 ± 100 | 43,000 ± 6,000 | >65,000 |
| 255 | 2,900 ± 500 | 55 ± 2 | 119,000 ± 15,000 | 99,000 ± 4,000 |
| 256 | 1,500 ± 200 | 880 ± 200 | 7,500 ± 800 | 7,100 ± 300 |
| 257 | 2,800 ± 600 | 320 ± 30 | 25,000 ± 2,000 | 26,000 ± 3,000 |
| 258 | >45,000 | >45,000 | >45,000 | >45,000 |
| 259 | 16000 ± 3000 | 2400 ± 200 | >85,000 | 4700 ± 400 |
| 260 | 1600 ± 500 | 150 ± 20 | >64,000 | 19000 ± 4500 |
| 261 | 6300 ± 1100 | 1000 ± 150 | 64000 ± 2000 | 38000 ± 2100 |
| 262 | 8700 ± 1300 | 3900 ± 570 | 287000 ± 14000 | 73000 ± 17000 |
| 263 | 2000 ± 300 | 1400 ± 200 | 124000 ± 18000 | 39000 ± 7000 |
| 264 | 1400 ± 100 | 76 ± 17 | >85,000 | 54000 ± 20000 |
| 265 | 810 ± 20 | 8 ± 1 | 1100 ± 200 | 250 ± 80 |
| 266 | 140 ± 20 | 70 ± 18 | 56000 ± 15000 | 32000 ± 7000 |
| 267 | 900 ± 160 | 160 ± 20 | >90,000 | 28000 ± 8000 |
| 268 | 2100 ± 200 | 330 ± 90 | 54,000 ± 16000 | >8,000 |
| 269 | 11000 ± 3000 | 850 ± 320 | 52000 ± 4000 | >7,000 |
| 270 | 8000 ± 1500 | 1300 ± 100 | >84,000 | 7100 ± 700 |
| 271 | 1700 ± 200 | 200 ± 90 | >93,000 | >9,300 |
| 272 | >46,000 | >4,700 | >47,000 | >4,700 |
| 273 | 30000 ± 5000 | >1,500 | >45,000 | >4,500 |
| 274 | 39000 ± 3000 | 1200 ± 300 | >46,000 | >4,500 |
| 275 | 1500 ± 300 | 370 ± 40 | >62,000 | >6,200 |
| 276 | 1500 ± 200 | 760 ± 100 | >61,000 | >6,100 |
| 277 | 760 ± 70 | 190 ± 20 | 31,000 ± 6000 | 9,800 ± 1000 |
| 278 | 1000 ± 100 | 270 ± 10 | >94000 | >9,400 |
| 279 | 1700 ± 400 | 190 ± 20 | >90000 | >9,000 |
| 280 | 2400 ± 800 | <80 | >83000 | >2,800 |
| 281 | 1800 ± 700 | 170 ± 10 | 27000 ± 2000 | 5000 ± 700 |
| 282 | 680 ± 60 | 110 ± 10 | >85000 | >8,500 |
| 283 | 2900 ± 1200 | 300 ± 20 | 40000 ± 4000 | >9,300 |
| 284 | 13,600(N = 2) | 340 ± 20 | >8,800 | |
| 285 | 3800 ± 1100 | 310 ± 20 | 84000 ± 9000 | 2000 ± 100 |
| 286 | 48000 ± 10000 | 6300 ± 200 | 51000 ± 1700 | >8,800 |
| 287 | 455000 ± 22000 | 1100 ± 100 | 567000 ± 17000 | 4700 ± 400 |
| 288 | 1800 ± 600 | 150 ± 20 | 11000 ± 3200 | ~9,000 |
| 289 | 51 ± 4 | 530 ± 150 | >290000 | >8,800 |
| 294 | 960 ± 170 | | | |
| 295 | 200 ± 44 | | | |
| 296 | 250 (N = 2) | | | |
| 297 | 2200 (N = 1) | | | |
| 298 | >7000 | | | |

SEQUENCE LISTING (181 sequences)

SEQ ID NO: 1 - protein, 351 aa, HOMO SAPIENS
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 2 - protein, 209 aa, HOMO SAPIENS
CDMQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 3 - protein, 495 aa, HOMO SAPIENS
MPMGSLQPLATLYLLGMLVASCLGRLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNPAGLAAGTVASIILALVLLVVLLVVCGPLAYKKLVKKFRQKKQRQWIGPTGMNQNMSFHRNHTATVRSHAENPTASHVDNEYSQPPRNSHLSAYPALEGALHRSSMQPDNSSDSDYDLHGAQRL

SEQ ID NO: 4 - protein, 240 aa, HOMO SAPIENS
MAGPPRLLLLPLLLALARGLPGALAAQEVQQSPHCTTVPVGASVNITCSTSGGLRGIYLRQLGPQPQDIIYYEDGVVPTTDRRFRGRIDFSGSQDNLTITMHRLQLSDTGTYTCQAITEVNVYGSGTLVLVTEEQSQGWHRCSDAPPRASALPAPPTGSALPDPQTASALPDPPAASALPAALAVISFLLGLGLGVACVLARTQIKKLCSWRDKNSAACVVYEDMSHSRCNTLSSPNQYQ

SEQ ID NO: 5 - protein, 556 aa, HOMO SAPIENS [sequence omitted]

SEQ ID NO: 6 - protein, 297 aa, HOMO SAPIENS
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 7 - protein, 847 aa, HOMO SAPIENS
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 8 - protein, 272 aa, HOMO SAPIENS
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 9 - protein, 594 aa, HOMO SAPIENS
RVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 10 - protein, 364 aa, HOMO SAPIENS
MPLLLLLPLLWAGALAMDPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 11 - protein, 281 aa, HOMO SAPIENS
MSAQESCLSLIKYFLFVFNLFFFVLGSLIFCFGIWILIDKTSFVSFVGLAFVPLQIWSKVLAISGIFTMGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLELGFMTLSIFLCRNLDHVYNRLARYR

SEQ ID NO: 12 - protein, 742 aa, HOMO SAPIENS
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 13 - protein, 429 aa, HOMO SAPIENS
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 14 - protein, 848 aa, HOMO SAPIENS [sequence omitted]

SEQ ID NO: 15 - protein, 193 aa, HOMO SAPIENS
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 16 - protein, 296 aa, HOMO SAPIENS
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKVLTKCQEEVSHIPAVHPGSFRPKCDENGNYLPLQCYGSIGYCWCVFPNGTEVPNTRSRGHHNCSESLELEDPSSGLGVTKQDLGPVPM

SEQ ID NO: 17 - protein, 226 aa, HOMO SAPIENS
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 18 - protein, 229 aa, HOMO SAPIENS
MARLALSPVPSHWMVALLLLLSAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 19 - protein, 288 aa, HOMO SAPIENS
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 20 - protein, 329 aa, HOMO SAPIENS
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 21 - protein, 310 aa, HOMO SAPIENS
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHQASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATGASQGLLDRKEVLGGVIAVGLVGLIFAVCLVGFMLYRMKKKDEGSYSLEEPKQANGGAYQKPTKQEEFYA

SEQ ID NO: 22 - protein, 459 aa, HOMO SAPIENS
MAPLCPSPWLPLLIPAPAPGLTVQLLLSLLLLVPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 23 - protein, 1048 aa, HOMO SAPIENS
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHIFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 24 - protein, 976 aa, HOMO SAPIENS
MELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 25 - protein, 188 aa, HOMO SAPIENS
MDCRKMARFSYSVIWIMAISKVFELGLVAGLGHQEFARPSRGYLAFRDDSIWPQEEPAIRPRSSQRVPPMGIQHSKELNRTCCLNGGTCMLGSFCACPPSFYGRNCEHDVRKENCGSVPHDTWLPKKCSLCKCWHGQLRCFPQAFLPGCDGLVMDEHLVASRTPELPPSARTTTFMLVGICLSIQSYY

SEQ ID NO: 26 - protein, 264 aa, HOMO SAPIENS
MTPGTQSPFFLLLLLTVLTATTAPKPATVVTGSGHASSTPGGEKETSATQRSSVPSSTEKNAFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 27 - protein, 875 aa, HOMO SAPIENS [sequence omitted]

SEQ ID NO: 28 - protein, 510 aa, HOMO SAPIENS
MPLSLGAEMWGPEAWLLLLLLLASFTGRCPAGELETSDVVTVVLGQDAKLPCFYRGDSGEQVGQVAWARVDAGEGAQELALLHSKYGLHVSPAYEGRVEQPPPPRNPLDGSVLLRNAVQADEGEYECRVSTFPAGSFQARLRLRVLVPPLPSLNPGPALEEGQGLTLAASCTAEGSPAPSVTWDTEVKGTTSSRSFKHSRSAAVTSEFHLVPSRSMNGQPLTCVVSHPGLLQDQRITHILHVSFLAEASVRGLEDQNLWHIGREGAMLKCLSEGQPPPSYNWTRLDGPLPSGVRVDGDTLGFPPLTTEHSGIYVCHVSNEFSSRDSQVTVDVLDPQEDSGKQVDLVSASVVVVGVIAALLFCLLVVVVVLMSRYHRRKAQQMTQKYEEELTLTRENSIRRLHSHHTDPRSQPEESVGLRAEGHPDSLKDNSSCSVMSEEPEGRSYSTLTTVREIETQTELLSPGSGRAEEEEDQDEGIKQAMNHFVQENGTLRAKPTGNGIYINGRGHLV

SEQ ID NO: 29 - protein, 622 aa, HOMO SAPIENS [sequence omitted]

SEQ ID NO: 30 - protein, 360 aa, HOMO SAPIENS
DPLGAAKPQWPWRRCLAALLFQLLVAVCFFSYLRVSRDDATGSPRAPSGSSRQDTTPTRPTLLILLWTWPFHIPVALSRCSEMVPGTADCHITADRKVYPQADTVIVHHWDIMSNPKSRLPPSPRPQGQRWIWFNLEPPPNCQHLEALDRYFNLTMSYRSDSDIFTPYGWLEPWSGQPAHPPLNLSAKTELVAWAVSNWKPDSARVRYYQSLQAHLKVDVYGRSHKPLPKGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALDFCKACWKLQQESRYQTVRSIAAWFT

SEQ ID NO: 31 - protein, 1210 aa, HOMO SAPIENS
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCKLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 32 - protein, 710 aa, HOMO SAPIENS
MGGKQRDEDDEAYGKPVKYDPSFRGPIKNRSCTDVICCVLFLLFILGYIVVGIVAWLYGDPRQVLYPRNSTGAYCGMGENKDKPYLLYFNIFSCILSSNIISVAENGLQCPTPQVCVSSCPEDPWTVGKNEFSQTVGEVFYTKNRNFCLPGVPWNMTVITSLQQELCPSFLLPSAPALGRCFPWTNVTPPALPGITNDTTIQQGISGLIDSLNARDISVKIFEDFAQSWYWILVALGVALVLSLLFILLLRLVAGPLVLVLILGVLGVLAYGIYYCWEEYRVLRDKGASISQLGFTTNLSAYQSVQETWLAALIVLAVLEAILLLMLIFLRQRIRIAIALLKEASKAVGQMMSTMFYPLVTFVLLLICIAYWAMTALYLATSGQPQYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLRGVQNPVARCIMCCFKCCLWCLEKFIKFLNRNAYIMIAIYGKNFCVSAKNAFMLLMRNIVRVVVLDKVTDLLLFFGKLLVVGGVGVLSFFFFSGRIPGLGKDFKSPHLNYYWLPIMTSILGAYVIASGFFSVFGMCVDTLFLCFLEDLERNNGSLDRPYYMSKSLLKILGKKNEAPPDNKKRKK

SEQ ID NO: 33 - protein, 442 aa, HOMO SAPIENS
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 34 - protein, 1255 aa, HOMO SAPIENS [sequence omitted]

SEQ ID NO: 35 - protein, 760 aa, HOMO SAPIENS
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTGTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 36 - protein, 334 aa, HOMO SAPIENS
MPLLPVLLVGTISKHLDWHRKEEKEHLKGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 37 - protein, 370 aa, HOMO SAPIENS
MHRLIFVYTLICANFCSCRDTSATPQSASIKALRNANLRRDESNHLTDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 38 - protein, 572 aa, HOMO SAPIENS
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLATTLKSYDSNTPGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 39 - protein, 701 aa, HOMO SAPIENS
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVAL

SEQ ID NO: 40 - protein, 702 aa, HOMO SAPIENS
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 41 - protein, 701 aa, HOMO SAPIENS; identical to SEQ ID NO: 39

SEQ ID NO: 42 - protein, 750 aa, HOMO SAPIENS
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 43 - protein, 22152 aa, HOMO SAPIENS
  misc_feature (13877)..(13878): Xaa can be any naturally occurring amino acid
  misc_feature (13880)..(13880): Xaa can be any naturally occurring amino acid
  misc_feature (13887)..(13887): Xaa can be any naturally occurring amino acid
  misc_feature (13890)..(13891): Xaa can be any naturally occurring amino acid
  misc_feature (13893)..(13893): Xaa can be any naturally occurring amino acid
  misc_feature (13903)..(13903): Xaa can be any naturally occurring amino acid
  misc_feature (13913)..(13914): Xaa can be any naturally occurring amino acid
  misc_feature (13916)..(13916): Xaa can be any naturally occurring amino acid
  misc_feature (13928)..(13929): Xaa can be any naturally occurring amino acid
  misc_feature (13938)..(13938): Xaa can be any naturally occurring amino acid
  misc_feature (13940)..(13941): Xaa can be any naturally occurring amino acid
  misc_feature (14569)..(14571): Xaa can be any naturally occurring amino acid
  misc_feature (14575)..(14575): Xaa can be any naturally occurring amino acid
  misc_feature (14579)..(14579): Xaa can be any naturally occurring amino acid
  misc_feature (14581)..(14581): Xaa can be any naturally occurring amino acid
  misc_feature (14587)..(14591): Xaa can be any naturally occurring amino acid
  misc_feature (14593)..(14594): Xaa can be any naturally occurring amino acid
  misc_feature (14725)..(14727): Xaa can be any naturally occurring amino acid
  misc_feature (14731)..(14731): Xaa can be any naturally occurring amino acid
  misc_feature (14735)..(14735): Xaa can be any naturally occurring amino acid
  misc_feature (14737)..(14737): Xaa can be any naturally occurring amino acid
  misc_feature (14743)..(14747): Xaa can be any naturally occurring amino acid
  misc_feature (14749)..(14750): Xaa can be any naturally occurring amino acid
  misc_feature (15661)..(15663): Xaa can be any naturally occurring amino acid
  misc_feature (15667)..(15667): Xaa can be any naturally occurring amino acid
  misc_feature (15671)..(15671): Xaa can be any naturally occurring amino acid
  misc_feature (15673)..(15673): Xaa can be any naturally occurring amino acid
  misc_feature (15679)..(15683): Xaa can be any naturally occurring amino acid
  misc_feature (15685)..(15686): Xaa can be any naturally occurring amino acid
  misc_feature (15972)..(15974): Xaa can be any naturally occurring amino acid
  misc_feature (15978)..(15978): Xaa can be any naturally occurring amino acid
  misc_feature (15982)..(15982): Xaa can be any naturally occurring amino acid
  misc_feature (15984)..(15984): Xaa can be any naturally occurring amino acid
  misc_feature (15990)..(15994): Xaa can be any naturally occurring amino acid
  misc_feature (15996)..(15997): Xaa can be any naturally occurring amino acid
  misc_feature (16008)..(16008): Xaa can be any naturally occurring amino acid
  misc_feature (16015)..(16015): Xaa can be any naturally occurring amino acid
  misc_feature (16017)..(16017): Xaa can be any naturally occurring amino acid
  misc_feature (16021)..(16021): Xaa can be any naturally occurring amino acid
  misc_feature (16025)..(16025): Xaa can be any naturally occurring amino acid
  misc_feature (16034)..(16034): Xaa can be any naturally occurring amino acid
  misc_feature (16037)..(16037): Xaa can be any naturally occurring amino acid
  misc_feature (16040)..(16040): Xaa can be any naturally occurring amino acid
  misc_feature (16046)..(16046): Xaa can be any naturally occurring amino acid
  misc_feature (16051)..(16051): Xaa can be any naturally occurring amino acid
  misc_feature (16053)..(16055): Xaa can be any naturally occurring amino acid
  misc_feature (16058)..(16058): Xaa can be any naturally occurring amino acid
  misc_feature (16062)..(16063): Xaa can be any naturally occurring amino acid
  misc_feature (16065)..(16065): Xaa can be any naturally occurring amino acid
  misc_feature (16072)..(16072): Xaa can be any naturally occurring amino acid
  misc_feature (16075)..(16076): Xaa can be any naturally occurring amino acid
  misc_feature (16078)..(16078): Xaa can be any naturally occurring amino acid
  misc_feature (16088)..(16088): Xaa can be any naturally occurring amino acid
  misc_feature (16268)..(16269): Xaa can be any naturally occurring amino acid
  misc_feature (16278)..(16278): Xaa can be any naturally occurring amino acid
  misc_feature (16280)..(16281): Xaa can be any naturally occurring amino acid
  misc_feature (16373)..(16374): Xaa can be any naturally occurring amino acid
  misc_feature (16376)..(16376): Xaa can be any naturally occurring amino acid
  misc_feature (16383)..(16383): Xaa can be any naturally occurring amino acid
  misc_feature (16386)..(16387): Xaa can be any naturally occurring amino acid
  misc_feature (16389)..(16389): Xaa can be any naturally occurring amino acid
  misc_feature (16399)..(16399): Xaa can be any naturally occurring amino acid
  misc_feature (16409)..(16410): Xaa can be any naturally occurring amino acid
  misc_feature (16412)..(16412): Xaa can be any naturally occurring amino acid
  misc_feature (16424)..(16425): Xaa can be any naturally occurring amino acid
  misc_feature (16434)..(16434): Xaa can be any naturally occurring amino acid
  misc_feature (16436)..(16437): Xaa can be any naturally occurring amino acid
  misc_feature (16439)..(16441): Xaa can be any naturally occurring amino acid
  misc_feature (16445)..(16445): Xaa can be any naturally occurring amino acid
  misc_feature (16449)..(16449): Xaa can be any naturally occurring amino acid
  misc_feature (16451)..(16451): Xaa can be any naturally occurring amino acid
  misc_feature (16457)..(16461): Xaa can be any naturally occurring amino acid
  misc_feature (16463)..(16464): Xaa can be any naturally occurring amino acid
  misc_feature (16841)..(16842): Xaa can be any naturally occurring amino acid
  misc_feature (16844)..(16844): Xaa can be any naturally occurring amino acid
  misc_feature (16851)..(16851): Xaa can be any naturally occurring amino acid
  misc_feature (16854)..(16855): Xaa can be any naturally occurring amino acid
  misc_feature (16857)..(16857): Xaa can be any naturally occurring amino acid
  misc_feature (16867)..(16867): Xaa can be any naturally occurring amino acid
  misc_feature (16877)..(16878): Xaa can be any naturally occurring amino acid
  misc_feature (16880)..(16880): Xaa can be any naturally occurring amino acid
  misc_feature (16892)..(16893): Xaa can be any naturally occurring amino acid
  misc_feature (16902)..(16902): Xaa can be any naturally occurring amino acid
  misc_feature (16904)..(16905): Xaa can be any naturally occurring amino acid
  misc_feature (16907)..(16909): Xaa can be any naturally occurring amino acid
  misc_feature (16913)..(16913): Xaa can be any naturally occurring amino acid
  misc_feature (16917)..(16917): Xaa can be any naturally occurring amino acid
  misc_feature (16919)..(16919): Xaa can be any naturally occurring amino acid
  misc_feature (16925)..(16929): Xaa can be any naturally occurring amino acid
  misc_feature (16931)..(16932): Xaa can be any naturally occurring amino acid
  misc_feature (17465)..(17466): Xaa can be any naturally occurring amino acid
  misc_feature (17468)..(17468): Xaa can be any naturally occurring amino acid
  misc_feature (17475)..(17475): Xaa can be any naturally occurring amino acid
  misc_feature (17478)..(17479): Xaa can be any naturally occurring amino acid
  misc_feature (17481)..(17481): Xaa can be any naturally occurring amino acid
  misc_feature (17491)..(17491): Xaa can be any naturally occurring amino acid
  misc_feature (17501)..(17502): Xaa can be any naturally occurring amino acid
  misc_feature (17504)..(17504): Xaa can be any naturally occurring amino acid
  misc_feature (17516)..(17517): Xaa can be any naturally occurring amino acid
  misc_feature (17526)..(17526): Xaa can be any naturally occurring amino acid
  misc_feature (17528)..(17529): Xaa can be any naturally occurring amino acid
  misc_feature (17531)..(17533): Xaa can be any naturally occurring amino acid
  misc_feature (17537)..(17537): Xaa can be any naturally occurring amino acid
  misc_feature (17541)..(17541): Xaa can be any naturally occurring amino acid
  misc_feature (17543)..(17543): Xaa can be any naturally occurring amino acid
  misc_feature (17549)..(17553): Xaa can be any naturally occurring amino acid
  misc_feature (17555)..(17556): Xaa can be any naturally occurring amino acid
  misc_feature (17567)..(17567): Xaa can be any naturally occurring amino acid
  misc_feature (17574)..(17574): Xaa can be any naturally occurring amino acid
  misc_feature (17576)..(17576): Xaa can be any naturally occurring amino acid
  misc_feature (17580)..(17580): Xaa can be any naturally occurring amino acid
  misc_feature (17584)..(17584): Xaa can be any naturally occurring amino acid
  misc_feature (17593)..(17593): Xaa can be any naturally occurring amino acid
  misc_feature (17596)..(17596): Xaa can be any naturally occurring amino acid
  misc_feature (17599)..(17599): Xaa can be any naturally occurring amino acid
  misc_feature (17605)..(17605): Xaa can be any naturally occurring amino acid
  misc_feature (17610)..(17610): Xaa can be any naturally occurring amino acid
  misc_feature (17612)..(17614): Xaa can be any naturally occurring amino acid
  misc_feature (17617)..(17617): Xaa can be any naturally occurring amino acid
  misc_feature (17621)..(17622): Xaa can be any naturally occurring amino acid
  misc_feature (17624)..(17624): Xaa can be any naturally occurring amino acid
  misc_feature (17631)..(17631): Xaa can be any naturally occurring amino acid
  misc_feature (17777)..(17778): Xaa can be any naturally occurring amino acid
  misc_feature (17780)..(17780): Xaa can be any naturally occurring amino acid
  misc_feature (17787)..(17787): Xaa can be any naturally occurring amino acid
  misc_feature (17790)..(17791): Xaa can be any naturally occurring amino acid
  misc_feature (17793)..(17793): Xaa can be any naturally occurring amino acid
  misc_feature (17803)..(17803): Xaa can be any naturally occurring amino acid
  misc_feature (17813)..(17814): Xaa can be any naturally occurring amino acid
  misc_feature (17816)..(17816): Xaa can be any naturally occurring amino acid
  misc_feature (17828)..(17829): Xaa can be any naturally occurring amino acid
  misc_feature (17838)..(17838): Xaa can be any naturally occurring amino acid
  misc_feature (17840)..(17841): Xaa can be any naturally occurring amino acid
  misc_feature (17843)..(17845): Xaa can be any naturally occurring amino acid
  misc_feature (17849)..(17849): Xaa can be any naturally occurring amino acid
  misc_feature (17853)..(17853): Xaa can be any naturally occurring amino acid
  misc_feature (17855)..(17855): Xaa can be any naturally occurring amino acid
  misc_feature (17861)..(17865): Xaa can be any naturally occurring amino acid
  misc_feature (17867)..(17868): Xaa can be any naturally occurring amino acid
  misc_feature (17879)..(17879): Xaa can be any naturally occurring amino acid
  misc_feature (17886)..(17886): Xaa can be any naturally occurring amino acid
  misc_feature (17888)..(17888): Xaa can be any naturally occurring amino acid
  misc_feature (17892)..(17892): Xaa can be any naturally occurring amino acid
  misc_feature (17896)..(17896): Xaa can be any naturally occurring amino acid
  misc_feature (17905)..(17905): Xaa can be any naturally occurring amino acid
  misc_feature (17908)..(17908): Xaa can be any naturally occurring amino acid
  misc_feature (17911)..(17911): Xaa can be any naturally occurring amino acid
  misc_feature (17917)..(17917): Xaa can be any naturally occurring amino acid
  misc_feature (17922)..(17922): Xaa can be any naturally occurring amino acid
  misc_feature (17924)..(17926): Xaa can be any naturally occurring amino acid
  misc_feature (17929)..(17929): Xaa can be any naturally occurring amino acid
  misc_feature (17933)..(17934): Xaa can be any naturally occurring amino acid
  misc_feature (17936)..(17936): Xaa can be any naturally occurring amino acid
  misc_feature (17943)..(17943): Xaa can be any naturally occurring amino acid
  misc_feature (17946)..(17947): Xaa can be any naturally occurring amino acid
  misc_feature (17949)..(17949): Xaa can be any naturally occurring amino acid
  misc_feature (17959)..(17959): Xaa can be any naturally occurring amino acid
  misc_feature (18089)..(18090): Xaa can be any naturally occurring amino acid
  misc_feature (18092)..(18092): Xaa can be any naturally occurring amino acid
  misc_feature (18099)..(18099): Xaa can be any naturally occurring amino acid
  misc_feature (18102)..(18103): Xaa can be any naturally occurring amino acid
  misc_feature (18105)..(18105): Xaa can be any naturally occurring amino acid
  misc_feature (18115)..(18115): Xaa can be any naturally occurring amino acid
  misc_feature (18125)..(18126): Xaa can be any naturally occurring amino acid
  misc_feature (18128)..(18128): Xaa can be any naturally occurring amino acid
  misc_feature (18140)..(18141): Xaa can be any naturally occurring amino acid
  misc_feature (18150)..(18150): Xaa can be any naturally occurring amino acid
  misc_feature (18152)..(18153): Xaa can be any naturally occurring amino acid
  misc_feature (18155)..(18157): Xaa can be any naturally occurring amino acid
  misc_feature (18161)..(18161): Xaa can be any naturally occurring amino acid
  misc_feature (18165)..(18165): Xaa can be any naturally occurring amino acid
  misc_feature (18167)..(18167): Xaa can be any naturally occurring amino acid
  misc_feature (18173)..(18177): Xaa can be any naturally occurring amino acid
  misc_feature (18179)..(18180): Xaa can be any naturally occurring amino acid
  misc_feature (18191)..(18191): Xaa can be any naturally occurring amino acid
  misc_feature (18198)..(18198): Xaa can be any naturally occurring amino acid
  misc_feature (18200)..(18200): Xaa can be any naturally occurring amino acid
  misc_feature (18204)..(18204): Xaa can be any naturally occurring amino acid
  misc_feature (18208)..(18208): Xaa can be any naturally occurring amino acid
  misc_feature (18217)..(18217): Xaa can be any naturally occurring amino acid
  misc_feature (18220)..(18220): Xaa can be any naturally occurring amino acid
  misc_feature (18223)..(18223): Xaa can be any naturally occurring amino acid
  misc_feature (18229)..(18229): Xaa can be any naturally occurring amino acid
  misc_feature (18234)..(18234): Xaa can be any naturally occurring amino acid
  misc_feature (18236)..(18238): Xaa can be any naturally occurring amino acid
  misc_feature (18241)..(18241): Xaa can be any naturally occurring amino acid
  misc_feature (18245)..(18246): Xaa can be any naturally occurring amino acid
  misc_feature (18248)..(18248): Xaa can be any naturally occurring amino acid
  misc_feature (18255)..(18255): Xaa can be any naturally occurring amino acid
  misc_feature (18258)..(18259): Xaa can be any naturally occurring amino acid
  misc_feature (18261)..(18261): Xaa can be any naturally occurring amino acid
  misc_feature (18271)..(18271): Xaa can be any naturally occurring amino acid
  misc_feature (18401)..(18402): Xaa can be any naturally occurring amino acid
  misc_feature (18404)..(18404): Xaa can be any naturally occurring amino acid
  misc_feature (18411)..(18411): Xaa can be any naturally occurring amino acid
  misc_feature (18414)..(18415): Xaa can be any naturally occurring amino acid
  misc_feature (18417)..(18417): Xaa can be any naturally occurring amino acid
  misc_feature (18427)..(18427): Xaa can be any naturally occurring amino acid
  misc_feature (18437)..(18438): Xaa can be any naturally occurring amino acid
  misc_feature (18440)..(18440): Xaa can be any naturally occurring amino acid
  misc_feature (18452)..(18453): Xaa can be any naturally occurring amino acid
  misc_feature (18462)..(18462): Xaa can be any naturally occurring amino acid
  misc_feature (18464)..(18465): Xaa can be any naturally occurring amino acid
  misc_feature (18467)..(18469): Xaa can be any naturally occurring amino acid
  misc_feature (18473)..(18473): Xaa can be any naturally occurring amino acid
  misc_feature (18477)..(18477): Xaa can be any naturally occurring amino acid
  misc_feature (18479)..(18479): Xaa can be any naturally occurring amino acid
  misc_feature (18485)..(18489): Xaa can be any naturally occurring amino acid
  misc_feature (18491)..(18492): Xaa can be any naturally occurring amino acid
  misc_feature (18503)..(18503): Xaa can be any naturally occurring amino acid
  misc_feature (18510)..(18510): Xaa can be any naturally occurring amino acid
  misc_feature (18512)..(18512): Xaa can be any naturally occurring amino acid
  misc_feature (18516)..(18516): Xaa can be any naturally occurring amino acid
  misc_feature (18520)..(18520): Xaa can be any naturally occurring amino acid
  misc_feature (18529)..(18529): Xaa can be any naturally occurring amino acid
  misc_feature (18532)..(18532): Xaa can be any naturally occurring amino acid
  misc_feature (18535)..(18535): Xaa can be any naturally occurring amino acid
  misc_feature (18541)..(18541): Xaa can be any naturally occurring amino acid
  misc_feature (18546)..(18546): Xaa can be any naturally occurring amino acid
  misc_feature (18548)..(18550): Xaa can be any naturally occurring amino acid
  misc_feature (18553)..(18553): Xaa can be any naturally occurring amino acid
  misc_feature (18557)..(18558): Xaa can be any naturally occurring amino acid
  misc_feature (18560)..(18560): Xaa can be any naturally occurring amino acid
  misc_feature (18567)..(18567): Xaa can be any naturally occurring amino acid
  misc_feature (18570)..(18571): Xaa can be any naturally occurring amino acid
  misc_feature (18573)..(18573): Xaa can be any naturally occurring amino acid
  misc_feature (18583)..(18583): Xaa can be any naturally occurring amino acid
  misc_feature (18713)..(18714): Xaa can be any naturally occurring amino acid
  misc_feature (18716)..(18716): Xaa can be any naturally occurring amino acid
  misc_feature (18723)..(18723): Xaa can be any naturally occurring amino acid
  misc_feature (18726)..(18727): Xaa can be any naturally occurring amino acid
  misc_feature (18729)..(18729): Xaa can be any naturally occurring amino acid
  misc_feature (18739)..(18739): Xaa can be any naturally occurring amino acid
  misc_feature (18749)..(18750): Xaa can be any naturally occurring amino acid
  misc_feature (18752)..(18752): Xaa can be any naturally occurring amino acid
  misc_feature (18764)..(18765): Xaa can be any naturally occurring amino acid
  misc_feature (18774)..(18774): Xaa can be any naturally occurring amino acid
  misc_feature (18776)..(18777): Xaa can be any naturally occurring amino acid
  misc_feature (18779)..(18781): Xaa can be any naturally occurring amino acid
  misc_feature (18785)..(18785): Xaa can be any naturally occurring amino acid
  misc_feature (18789)..(18789): Xaa can be any naturally occurring amino acid
  misc_feature (18791)..(18791): Xaa can be any naturally occurring amino acid
  misc_feature (18797)..(18801): Xaa can be any naturally occurring amino acid
  misc_feature (18803)..(18804): Xaa can be any naturally occurring amino acid
  misc_feature (18815)..(18815): Xaa can be any naturally occurring amino acid
  misc_feature (18822)..(18822): Xaa can be any naturally occurring amino acid
  misc_feature (18824)..(18824): Xaa can be any naturally occurring amino acid
  misc_feature (18828)..(18828): Xaa can be any naturally occurring amino acid
  misc_feature (18832)..(18832): Xaa can be any naturally occurring amino acid
  misc_feature (18841)..(18841): Xaa can be any naturally occurring amino acid
  misc_feature (18844)..(18844): Xaa can be any naturally occurring amino acid
  misc_feature (18847)..(18847): Xaa can be any naturally occurring amino acid
  misc_feature (18853)..(18853): Xaa can be any naturally occurring amino acid
  misc_feature (18858)..(18858): Xaa can be any naturally occurring amino acid
  misc_feature (18860)..(18862): Xaa can be any naturally occurring amino acid
  misc_feature (18865)..(18865): Xaa can be any naturally occurring amino acid
  misc_feature (18869)..(18870): Xaa can be any naturally occurring amino acid
  misc_feature (18872)..(18872): Xaa can be any naturally occurring amino acid
  misc_feature (18879)..(18879): Xaa can be any naturally occurring amino acid
  misc_feature (18882)..(18883): Xaa can be any naturally occurring amino acid
  misc_feature (18885)..(18885): Xaa can be any naturally occurring amino acid
  misc_feature (18895)..(18895): Xaa can be any naturally occurring amino acid
  misc_feature (19091)..(19093): Xaa can be any naturally occurring amino acid
  misc_feature (19097)..(19097): Xaa can be any naturally occurring amino acid
  misc_feature (19101)..(19101): Xaa can be any naturally occurring amino acid
  misc_feature (19103)..(19103): Xaa can be any naturally occurring amino acid
  misc_feature (19109)..(19113): Xaa can be any naturally occurring amino acid
  misc_feature (19115)..(19116): Xaa can be any naturally occurring amino acid
  misc_feature (19127)..(19127): Xaa can be any naturally occurring amino acid
  misc_feature (19134)..(19134): Xaa can be any naturally occurring amino acid
  misc_feature (19136)..(19136): Xaa can be any naturally occurring amino acid
  misc_feature (19140)..(19140): Xaa can be any naturally occurring amino acid
  misc_feature (19144)..(19144): Xaa can be any naturally occurring amino acid
  misc_feature (19153)..(19153): Xaa can be any naturally occurring amino acid
  misc_feature (19156)..(19156): Xaa can be any naturally occurring amino acid
  misc_feature (19159)..(19159): Xaa can be any naturally occurring amino acid
  misc_feature (19165)..(19165): Xaa can be any naturally occurring amino acid
  misc_feature (19170)..(19170): Xaa can be any naturally occurring amino acid
  misc_feature (19172)..(19174): Xaa can be any naturally occurring amino acid
  misc_feature (19177)..(19177): Xaa can be any naturally occurring amino acid
  misc_feature (19181)..(19182): Xaa can be any naturally occurring amino acid
  misc_feature (19184)..(19184): Xaa can be any naturally occurring amino acid
  misc_feature (19191)..(19191): Xaa can be any naturally occurring amino acid
  misc_feature (19194)..(19195): Xaa can be any naturally occurring amino acid
  misc_feature (19197)..(19197): Xaa can be any naturally occurring amino acid
  misc_feature (19207)..(19207): Xaa can be any naturally occurring amino acid
  misc_feature (19337)..(19338): Xaa can be any naturally occurring amino acid
  misc_feature (19340)..(19340): Xaa can be any naturally occurring amino acid
  misc_feature (19347)..(19347): Xaa can be any naturally occurring amino acid
  misc_feature (19350)..(19351): Xaa can be any naturally occurring amino acid
  misc_feature (19353)..(19353): Xaa can be any naturally occurring amino acid
  misc_feature (19363)..(19363): Xaa can be any naturally occurring amino acid
  misc_feature (19373)..(19374): Xaa can be any naturally occurring amino acid
  misc_feature (19376)..(19376): Xaa can be any naturally occurring amino acid
  misc_feature (19388)..(19389): Xaa can be any naturally occurring amino acid
  misc_feature (19398)..(19398): Xaa can be any naturally occurring amino acid
  misc_feature (19400)..(19401): Xaa can be any naturally occurring amino acid
  misc_feature (19403)..(19405): Xaa can be any naturally occurring amino acid
  misc_feature (19409)..(19409): Xaa can be any naturally occurring amino acid
  misc_feature (19413)..(19413): Xaa can be any naturally occurring amino acid
  misc_feature (19415)..(19415): Xaa can be any naturally occurring amino acid
  misc_feature (19421)..(19425): Xaa can be any naturally occurring amino acid
  misc_feature (19427)..(19428): Xaa can be any naturally occurring amino acid
  misc_feature (19439)..(19439): Xaa can be any naturally occurring amino acid
  misc_feature (19446)..(19446): Xaa can be any naturally occurring amino acid
  misc_feature (19448)..(19448): Xaa can be any naturally occurring amino acid
  misc_feature (19452)..(19452): Xaa can be any naturally occurring amino acid
  misc_feature (19456)..(19456): Xaa can be any naturally occurring amino acid
  misc_feature (19465)..(19465): Xaa can be any naturally occurring amino acid
  misc_feature (19468)..(19468): Xaa can be any naturally occurring amino acid
  misc_feature (19471)..(19471): Xaa can be any naturally occurring amino acid
  misc_feature (19477)..(19477): Xaa can be any naturally occurring amino acid
  misc_feature (19482)..(19482): Xaa can be any naturally occurring amino acid
  misc_feature (19484)..(19486): Xaa can be any naturally occurring amino acid
  misc_feature (19489)..(19489): Xaa can be any naturally occurring amino acid
  misc_feature (19493)..(19494): Xaa can be any naturally occurring amino acid
  misc_feature (19496)..(19496): Xaa can be any naturally occurring amino acid
  misc_feature (19503)..(19503): Xaa can be any naturally occurring amino acid
  misc_feature (19506)..(19507): Xaa can be any naturally occurring amino acid
  misc_feature (19509)..(19509): Xaa can be any naturally occurring amino acid
  misc_feature (19519)..(19519): Xaa can be any naturally occurring amino acid
  misc_feature (19649)..(19650): Xaa can be any naturally occurring amino acid
  misc_feature (19652)..(19652): Xaa can be any naturally occurring amino acid
  misc_feature (19659)..(19659): Xaa can be any naturally occurring amino acid
  misc_feature (19662)..(19663): Xaa can be any naturally occurring amino acid
  misc_feature (19665)..(19665): Xaa can be any naturally occurring amino acid
  misc_feature (19675)..(19675): Xaa can be any naturally occurring amino acid
  misc_feature (19685)..(19686): Xaa can be any naturally occurring amino acid
  misc_feature (19688)..(19688): Xaa can be any naturally occurring amino acid
  misc_feature (19700)..(19701): Xaa can be any naturally occurring amino acid
  misc_feature (19710)..(19710): Xaa can be any naturally occurring amino acid
  misc_feature (19712)..(19713): Xaa can be any naturally occurring amino acid
  misc_feature (19715)..(19717): Xaa can be any naturally occurring amino acid
  misc_feature (19721)..(19721): Xaa can be any naturally occurring amino acid
  misc_feature (19725)..(19725): Xaa can be any naturally occurring amino acid
  misc_feature (19727)..(19727): Xaa can be any naturally occurring amino acid
  misc_feature (19733)..(19737): Xaa can be any naturally occurring amino acid
  misc_feature (19739)..(19740): Xaa can be any naturally occurring amino acid
  misc_feature (19751)..(19751): Xaa can be any naturally occurring amino acid
  misc_feature (19758)..(19758): Xaa can be any naturally occurring amino acid
  misc_feature (19760)..(19760): Xaa can be any naturally occurring amino acid
  misc_feature (19764)..(19764): Xaa can be any naturally occurring amino acid
  misc_feature (19768)..(19768): Xaa can be any naturally occurring amino acid
  misc_feature (19777)..(19777): Xaa can be any naturally occurring amino acid
  misc_feature (19780)..(19780): Xaa can be any naturally occurring amino acid
  misc_feature (19783)..(19783): Xaa can be any naturally occurring amino acid
  misc_feature (19789)..(19789): Xaa can be any naturally occurring amino acid
  misc_feature (19794)..(19794): Xaa can be any naturally occurring amino acid
  misc_feature (19796)..(19798): Xaa can be any naturally occurring amino acid
  misc_feature (19801)..(19801): Xaa can be any naturally occurring amino acid
  misc_feature (19805)..(19806): Xaa can be any naturally occurring amino acid
  misc_feature (19808)..(19808): Xaa can be any naturally occurring amino acid
  misc_feature (19815)..(19815): Xaa can be any naturally occurring amino acid
  misc_feature (19818)..(19819): Xaa can be any naturally occurring amino acid
  misc_feature (19821)..(19821): Xaa can be any naturally occurring amino acid
  misc_feature (19831)..(19831): Xaa can be any naturally occurring amino acid
  misc_feature (19960)..(19961): Xaa can be any naturally occurring amino acid
  misc_feature (19963)..(19963): Xaa can be any naturally occurring amino acid
  misc_feature (19970)..(19970): Xaa can be any naturally occurring amino acid
  misc_feature (19973)..(19974): Xaa can be any naturally occurring amino acid
  misc_feature (19976)..(19976): Xaa can be any naturally occurring amino acid
  misc_feature (19986)..(19986): Xaa can be any naturally occurring amino acid
  misc_feature (19996)..(19997): Xaa can be any naturally occurring amino acid
  misc_feature (19999)..(19999): Xaa can be any naturally occurring amino acid
  misc_feature (20011)..(20012): Xaa can be any naturally occurring amino acid
  misc_feature (20021)..(20021): Xaa can be any naturally occurring amino acid
  misc_feature (20023)..(20024): Xaa can be any naturally occurring amino acid
  misc_feature (20026)..(20028): Xaa can be any naturally occurring amino acid
  misc_feature (20032)..(20032): Xaa can be any naturally occurring amino acid
  misc_feature (20036)..(20036): Xaa can be any naturally occurring amino acid
  misc_feature (20038)..(20038): Xaa can be any naturally occurring amino acid
  misc_feature (20044)..(20048): Xaa can be any naturally occurring amino acid
  misc_feature (20050)..(20051): Xaa can be any naturally occurring amino acid
  misc_feature (20062)..(20062): Xaa can be any naturally occurring amino acid
  misc_feature (20069)..(20069): Xaa can be any naturally occurring amino acid
  misc_feature (20071)..(20071): Xaa can be any naturally occurring amino acid
  misc_feature (20075)..(20075): Xaa can be any naturally occurring amino acid
  misc_feature (20079)..(20079): Xaa can be any naturally occurring amino acid
  misc_feature (20088)..(20088): Xaa can be any naturally occurring amino acid
  misc_feature (20091)..(20091): Xaa can be any naturally occurring amino acid
  misc_feature (20094)..(20094): Xaa can be any naturally occurring amino acid
  misc_feature (20100)..(20100): Xaa can be any naturally occurring amino acid
  misc_feature (20105)..(20105): Xaa can be any naturally occurring amino acid
  misc_feature (20107)..(20109): Xaa can be any naturally occurring amino acid
  misc_feature (20112)..(20112): Xaa can be any naturally occurring amino acid
  misc_feature (20116)..(20117): Xaa can be any naturally occurring amino acid
  misc_feature (20119)..(20119): Xaa can be any naturally occurring amino acid
  misc_feature (20126)..(20126): Xaa can be any naturally occurring amino acid
  misc_feature (20129)..(20130): Xaa can be any naturally occurring amino acid
  misc_feature (20132)..(20132): Xaa can be any naturally occurring amino acid
  misc_feature (20142)..(20142): Xaa can be any naturally occurring amino acid
  misc_feature (20272)..(20273): Xaa can be any naturally occurring amino acid
  misc_feature (20275)..(20275): Xaa can be any naturally occurring amino acid
  misc_feature (20282)..(20282): Xaa can be any naturally occurring amino acid
  misc_feature (20285)..(20286): Xaa can be any naturally occurring amino acid
  misc_feature (20288)..(20288): Xaa can be any naturally occurring amino acid
  misc_feature (20298)..(20298): Xaa can be any naturally occurring amino acid
  misc_feature (20308)..(20309): Xaa can be any naturally occurring amino acid
  misc_feature (20311)..(20311): Xaa can be any naturally occurring amino acid
  misc_feature (20323)..(20324): Xaa can be any naturally occurring amino acid
  misc_feature (20333)..(20333): Xaa can be any naturally occurring amino acid
  misc_feature (20335)..(20336): Xaa can be any naturally occurring amino acid
  misc_feature (20806)..(20808): Xaa can be any naturally occurring amino acid
  misc_feature (20812)..(20812): Xaa can be any naturally occurring amino acid
  misc_feature (20816)..(20816): Xaa can be any naturally occurring amino acid
  misc_feature (20818)..(20818): Xaa can be any naturally occurring amino acid
  misc_feature (20824)..(20828): Xaa can be any naturally occurring amino acid
  misc_feature (20830)..(20831): Xaa can be any naturally occurring amino acid
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTIKLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTDTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWASVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPSTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGTSPAGTSPGSPEVSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVSTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLKDPEYAGHKLGIWDDFIPKFGKAAHMRELPLLSPPQDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGPRTEITSSKRISSSFLAQSMRSSDSPSEAITRLSNFPAMTESGGMILAMQTSPPGATSLSAPTLDTSATASWTGTPLATTQRFTYSEKTTLFSKGPEDTSQPSPPSVEETSSSSSLVPIHATTSPSNILLTSQGHSPSSTPPVTSVFLSETSGLGKTTDMSRISLEPGTSLPPNLSSTAGEALSTYEASRDTKAIHHSADTAVTNMEATSSEYSPIPGHTKPSKATSPLVTSHIMGDITSSTSVFGSSETTEIETVSSVNQGLQERSTSQVASSATETSTVITHVSSGDATTHVTKTQATFSSGTSISSPHQFITSTNTFTDVSTNPSTSLIMTESSGVTITTQTGPTGAATQGPYLLDTSTMPYLTETPLAVTPDFMQSEKTTLISKGPKDVTWTSPPSVAETSYPSSLTPFLVTTIPPATSTLQGQHTSSPVSATSVLTSGLVKTTDMLNTSMEPVTNSPQNLNNPSNEILATLAATTDIETIHPSINKAVTNMGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTPSVVTEGFAHSKITTAMNNDVKDVSQTNPPFQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKVTSPNVTTSTMEDTTISRSIPKSSKTTRTETETTSSLTPKLRETSISQEITSSTETSTVPYKELTGATTEVSRTDVTSSSSTSFPGPDQSTVSLDISTETNTRLSTSPIMTESAEITITTQTGPHGATSQDTFTMDPSNTTPQAGIHSAMTHGFSQLDVTTLMSRIPQDVSWTSPPSVDKTSSPSSFLSSPAMTTPSLISSTLPEDKLSSPMTSLLTSGLVKITDILRTRLEPVTSSLPNFSSTSDKILATSKDSKDTKEIFPSINTEETNVKANNSGHESHSPALADSETPKATTQMVITTTVGDPAPSTSMPVHGSSETTNIKREPTYFLTPRLRETSTSQESSFPTDTSFLLSKVPTGTITEVSSTGVNSSSKISTPDHDKSTVPPDTFTGEIPRVFTSSIKTKSAEMTITTQASPPESASHSTLPLDTSTTLSQGGTHSTVTQGFPYSEVTTLMGMGPGNVSWMTTPPVEETSSVSSLMSSPAMTSPSPVSSTSPQSIPSSPLPVTALPTSVLVTTTDVLGTTSPESVTSSPPNLSSITHERPATYKDTAHTEAAMHHSTNTAVTNVGTSGSGHKSQSSVLADSETSKATPLMSTTSTLGDTSVSTSTPNISQTNQIQTEPTASLSPRLRESSTSEKTSSTTETNTAFSYVPTGAITQASRTEISSSRTSISDLDRPTIAPDISTGMITRLFTSPIMTKSAEMTVTTQTTTPGATSQGILPWDTSTTLFQGGTHSTVSQGFPHSEITTLRSRTPGDVSWMTTPPVEETSSGFSLMSPSMTSPSPVSSTSPESIPSSPLPVTALLTSVLVTTTNVLGTTSPETVTSSPPNLSSPTQERLTTYKDTAHTEAMHASMHTNTAVANVGTSISGHESQSSVPADSHTSKATSPMGITFAMGDTSVSTSTPAFFETRIQTESTSSLIPGLRDTRTSEEINTVTETSTVLSEVPTTTTTEVSRTEVITSSRTTISGPDHSKMSPYISTETITRLSTFPFVTGSTEMAITNQTGPIGTISQATLTLDTSSTASWEGTHSPVTQRFPHSEETTTMSRSTKGVSWQSPPSVEETSSPSSPVPLPAITSHSSLYSAVSGSSPTSALPVTSLLTSGRRKTIDMLDTHSELVTSSLPSASSFSGEILTSEASTNTETIHFSENTAETNMGTTNSMHKLHSSVSIHSQPSGHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAMANVGTTSSPNEFYFTVSPDSDPYKATSAVVITSTSGDSIVSTSMPRSSAMKKIESETTFSLIFRLRETSTSQKIGSSSDTSTVFDKAFTAATTEVSRTELTSSSRTSIQGTEKPTMSPDTSTRSVTMLSTFAGLTKSEERTIATQTGPHRATSQGTLTWDTSITTSQAGTHSAMTHGFSQLDLSTLTSRVPEYISGTSPPSVEKTSSSSSLLSLPAITSPSPVPTTLPESRPSSPVHLTSLPTSGLVKTTDMLASVASLPPNLGSTSHKIPTTSEDIKDTEKMYPSTNIAVTNVGTTTSEKESYSSVPAYSEPPKVTSPMVTSFNIRDTIVSTSMPGSSEITRIEMESTFSVAHGLKGTSTSQDPIVSTEKSAVLHKLTTGATETSRTEVASSRRTSIPGPDHSTESPDISTEVIPSLPISLGITESSNMTIITRTGPPLGSTSQGTFTLDTPTTSSRAGTHSMATQEFPHSEMTTVMNKDPEILSWTIPPSIEKTSFSSSLMPSPAMTSPPVSSTLPKTIHTTPSPMTSLLTPSLVMTTDTLGTSPEPTTSSPPNLSSTSHVILTTDEDTTAIEAMHPSTSTAATNVETTCSGHGSQSSVLTDSEKTKATAPMDTTSTMGHTTVSTSMSVSSETTKIKRESTYSLTPGLRETSISQNASFSTDTSIVLSEVPTGTTAEVSRTEVTSSGRTSIPGPSQSTVLPEISTRTMTRLFASPTMTESAEMTIPTQTGPSGSTSQDTLTLDTSTTKSQAKTHSTLTQRFPHSEMTTLMSRGPGDMSWQSSPSLENPSSLPSLLSLPATTSPPPISSTLPVTISSSPLPVTSLLTSSPVTTTDMLHTSPELVTSSPPKLSHTSDERLTTGKDTTNTEAVHPSTNTAASNVEIPSFGHESPSSALADSETSKATSPMFITSTQEDTTVAISTPHFLETSRIQKESISSLSPKLRETGSSVETSSAIETSAVLSEVSIGATTEISRTEVTSSSRTSISGSAESTMLPEISTTRKIIKFPTSPILAESSEMTIKTQTSPPGSTSESTFTLDTSTTPSLVITHSTMTQRLPHSEITTLVSRGAGDVPRPSSLPVEETSPPSSQLSLSAMISPSPVSSTLPASSHSSSASVTSPLTPGQVKTTEVLDASAEPETSSPPSLSSTSVEILATSEVTTDTEKIHPFPNTAVTKVGTSSSGHESPSSVLPDSETTKATSAMGTISIMGDTSVSTLTPALSNTRKIQSEPASSLTTRLRETSTSEETSLATEANTVLSKVSTGATTEVSRTEAISFSRTSMSGPEQSTMSQDISIGTIPRISASSVLTESAKMTITTQTGPSESTLESTLNLNTATTPSWVETHSIVIQGFPHPEMTTSMGRGPGGVSWPSPPFVKETSPPSSPLSLPAVTSPHPVSTTFLAHIPPSPLPVTSLLTSGPATTTDILGTSTEPGTSSSSSLSTTSHERLTTYKDTAHTEAVHPSTNTGGTNVATTSSGYKSQSSVLADSSPMCTTSTMGDTSVLTSTPAFLETRRIQTELASSLTPGLRESSGSEGTSSGTKMSTVLSKVPTGATTEISKEDVTSIPGPAQSTISPDISTRTVSWFSTSPVMTESAEITMNTHTSPLGATTQGTSTLATSSTTSLTMTHSTISQGFSHSQMSTLMRRGPEDVSWMSPPLLEKTRPSFSLMSSPATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPSPVSSTLVEDFPSASLPVTSLLTPGLVITTDRMGISREPGTSSTSNLSSTSHERLTTLEDTVDTEDMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSALPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISSEVITRLSTSPIKAESTEMTITTQTGSPGATSRGTLTLDTSTTFMSGTHSTASQGFSHSQMTALMSRTPGDVPWLSHPSVEEASSASFSLSSPVMTSSSPVSSTLPDSIHSSSLPVTSLLTSGLVKTTELLGTSSEPETSSPPNLSSTSAEILATTEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPQSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLATSKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMSSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVDDTTVFTSNPAFSETRRIPTEPTFSLTPGFRETSTSEETTSITETSAVLYGVPTSATTEVSMTEIMSSNRTHIPDSDQSTMSPDIITEVITRLSSSSMMSESTQMTITTQKSSPGATAQSTLTLATTTAPLARTHSTVPPRFLHSEMTTLMSRSPENPSWKSSPFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSTPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASRQMASTILTEMMITTPYVFPDVPETTSSLATSLGAETSTALPRTTPSVLNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPKTTPKFSHSKSDTTLPVAITSPGPEASSAVSTTTISPDMSDLVTSLVPSSGTDTSTTFPTLSETPYEPETTVTWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTGTSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTAAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTTSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLDREQLYWELSQLTNGIKELGPYTLDRNSLYVNGFTHWIPVPTSSTPGTSTVDLGSGTPSSLPSPTAAGPLLVPFTLNFTITNLQYEEDMHHPGSRKFNTTERVLQGLLGPMFKNTSVGLLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMRHPGSRKFNTTERVLQGLLKPLFKSTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNTTERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTLLRPEKHEAATGVDTICTHRVDPIGPGLDRERLYWELSQLTNSITELGPYTLDRDSLYVNGFNPRSSVPTTSTPGTSTVHLATSGTPSSLPGHTAPVPLLIPFTLNFTITNLHYEENMQHPGSRKFNTTERVLQGLLKPLFKNTSVGPLYSGCRLTLLRPEKHEAATGVDTICTHRVDPIGPGLXXEXLYWELSXLTXXIXELGPYTLDRXSLYVNGFTHXXSXPTTSTPGTSTVXXGTSGTPSSXPXXTSAGPLLVPFTLNFTITNLQYEEDMHHPGSRKFNTTERVLQGLLGPMFKNTSVGLLYSGCRLTLLRPEKNGAATGMDAICSHRLDPKSPGLDREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQSSMTTTRTPDTSTMHLATSRTPASLSGPTTASPLLVLFTINCTITNLQYEEDMRRTGSRKFNTMESVLQGLLKPLFKNTSVGPLYSGCRLTLLRPKKDGAATGVDAICTHRLDPKSPGLNREQLYWELSKLTNDIEELGPYTLDRNSLYVNGFTHQSSVSTTSTPGTSTVDLRTSGTPSSLSSPTIMXXXPLLXPFTXNXTITNLXXXXXMXXPGSRKFNTTERVLQGLLRPLFKNTSVSSLYSGCRLTLLRPEKDGAATRVDAACTYRPDPKSPGLDREQLYWELSQLTHSITELGPYTLDRVSLYVNGFNPRSSVPTTSTPGTSTVHLATSGTPSSLPGHTXXXPLLXPFTXNXTITNLXXXXXMXXPGSRKFNTTERVLQGLLKPLFRNSSLEYLYSGCRLASLRPEKDSSAMAVDAICTHRPDPEDLGLDRERLYWELSNLTNGIQELGPYTLDRNSLYVNGFTHRSSGLTTSTPWTSTVDLGTSGTPSPVPSPTTAGPLLVPFTLNFTITNLQYEEDMHRPGSRRFNTTERVLQGLLTPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFSTTERVLQGLLKPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTTLRPKKDGAATKVDAICTYRPDPKSPGLDREQLYWELSQLTHSITELGPYTQDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRTSVPTTSTPGTSTVDLGTSGTPFSLPSPAXXXPLLXPFTXNXTITNLXXXXXMXXPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTSLRSEKDGAATGVDAICTHRVDPKSPGVDREQLYWELSQLTNGIKELGPYTLDRNSLYVNGFTHQTSAPNTSTPGTSTVXXGTSGTPSSXPXXTSAGPLLVPFTLNFTITNLQYEEDMHHPGSRKFNTTERVLQGLLGPMFKNTSVGLLYSGCRLTLLRPEKNGATTGMDAICTHRLDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLIPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTTSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETTGTPSSFPGHTEPGPLLIPFTFNFTITNLRYEENMQHPGSRKFNTTERVLQGLLTPLFKNTSVGPLYSGCRLTLLRPEKQEAATGVDTICTHRVDPIGPGLDRERLYWELSQLTNSITELGPYTLDRDSLYVDGFNPWSSVPTTSTPGTSTVHLATSGTPSPLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSITELGPYTLDRDSLYVNGFNPWSSVPTTSTPGTSTVHLATSGTPSSLPGHTTAGPLLVPFTLNFTITNLKYEEDMHCPGSRKFNTTERVLQSLHGPMFKNTSVGPLYSGCRLTLLRSEKDGAATGVDAICTHRLDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTNSITELGPYTLDRDSLYVNGFTHRSSMPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFHPRSSVPTTSTPGTSTVHLATSGTPSSLPGHTAPVPLLIPFTLNFTITNLHYEENMQHPGSRKFNTTERVLQGLLGPMFKNTSVGLLYSGCRLTLLRPEKNGAATGMDAICSHRLDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHQNSVPTTSTPGTSTVYWATTGTPSSFPGHTEPGPLLIPFTFNFTITNLHYEENMQHPGSRKFNTTERVLQGLLTPLFKNTSVGPLYSGCRLTLLRPEKQEAATGVDTICTHRVDPIGPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHRSSVPTTSSPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTLRLDPTGPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHRTSVPTTSTPGTSTVHLATSGTPSSLPGHTAPVPLLIPFTLNFTITNLQYEEDMHRPGSRKFNTTERVLQGLLSPIFKNSSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHWSSGLTTSTPWTSTVDLGTSGTPSPVPSPTTAGPLLVPFTLNFTITNLQYEEDMHRPGSRKFNATERVLQGLLSPIFKNTSVGPLYSGCRLTLLRPEKQEAATGVDTICTHRVDPIGPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHRSFGLTTSTPWTSTVDLGTSGTPSPVPSPTTAGPLLVPFTLNFTITNLQYEEDMHRPGSRKFNTTERVLQGLLTPLFRNTSVSSLYSGCRLTLLRPEKDGAATRVDAVCTHRPDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHWIPVPTSSTPGTSTVDLGSGTPSSLPSPTTAGPLLVPFTLNFTITNLQYGEDMGHPGSRKFNTTERVLQGLLGPIFKNTSVGPLYSGCRLTSLRSEKDGAATGVDAICIHHLDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHQTFAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATRVDAVCTHRPDPKSPGLXXEXLYWELSXLTXXIXELGPYTLDRXSLYVNGFTHXXSXPTTSTPGTSTVXXGTSGTPSSXPXXTAPVPLLIPFTLNFTITNLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTQRSSVPTTSIPGTSAVHLETSGTPASLPGHTAPGPLLVPFTLNFTITNLQYEVDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTXXXPLLXPFTXNXTITNLXXXXXMXXPGSRKFNTTERVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGHYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGSRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMKHLLSPLFQRSSLGARYTGCRVIALRSVKNGAETRVDLLCTYLQPLSGPGLPIKQVFHELSQQTHGITRLGPYSLDKDSLYLNGYNEPGLDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 44 - protein, 255 aa, HOMO SAPIENS
MTPGTQSPFFLLLLLTVLTVVTGSGHASSTPGGEKETSATQRSSVPSSTEKNAFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 45 - protein, 560 aa, HOMO SAPIENS
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 46 - protein, 551 aa, HOMO SAPIENS
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 47 - protein, 427 aa, HOMO SAPIENS
MEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRVKPDPPHIKNLSFHNDDLYVQWENPQNFISRCLFYEVEVNNSQTETHNVFYVQEAKCENPEFERNVENTSCFMVPGVLPDTLNTVRIRVKTNKLCYEDDKLWSNWSQEMSIGKKRNSTLYITMLLIVPVIVAGAIIVLLLYLKRLKIIIFPPIPDPGKIFKEMFGDQNDDTLHWKKYDIYEKQTKEETDSVVLIENLKKASQ

SEQ ID NO: 48 - protein, 323 aa, HOMO SAPIENS
MARGPGLAPPPLRLPLLLLVLAAVTGHTAAQDNCTCPTNKMTVCSPDGPGGRCQCRALGSGMAVDCSTLTSKCLLLKARMSAPKNARTLVRPSEHALVDNDGLYDPDCDPEGRFKARQCNQTSVCWCVNSVGVRRTDKGDLSLRCDELVRTHHILIDLRHRPTAGAFNHSDLDAELRRLFRERYRLHPKFVAAVHYEQPTIQIELRQNTSQKAAGDVDIGDAAYYFERDIKGESLFQGRGGLDLRVRGEPLQVERTLIYYLDEIPPKFSMKRLTAGLIAVIVVVVVALVAGMAVLVITNRRKSGKYKKVEIKELGELRKEPSL

SEQ ID NO: 49 - protein, 257 aa, HOMO SAPIENS
MAQRMTTQLLLLLVWVAVVGEAQTRIAWARTELLNVCMNAKHHKEKPGPEDKLHEQCRPWRKNACCSTNTSQEAHKDVSYLYRFNWNHCGEMAPACKRHFIQDTCLYECSPNLGPWIQQVDQSWRKERVLNVPLCKEDCEQWWEDCRTSYTCKSNWHKGWNWTSGFNKCAVGAACQPFHFYFPTPTVLCNEIWTHSYKVSNYSRGSGRCIQMWFDPAQGNPNEEVARFYAAAMSGAGPWAAWPFLLSLALMLLWLLS

SEQ ID NO: 50 - protein, 4130 aa, HOMO SAPIENS
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTIKLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTYTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWTSVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGSSPAGTSPGSPEMSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVSTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLRTLNTLDINLESGTTSSPSWKSSPYERIAPSESTTDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGPRTEITSSKRISSSFLAQSMRSSDSPSEAITRLSNFPAMTESGGMILAMQTSPPGATSLSAPTLDTSATASWTGTPLATTQRFT

SEQ ID NO: 51 - protein, 442 aa, HOMO SAPIENS [sequence omitted]

SEQ ID NO: 52 - protein, 339 aa, HOMO SAPIENS
MESRKDITNQEELWKMKPRRNLEEDDYLHKDTGETSMLKRPVLLHLHQTAHADEFDCPSELQHTQELFPQWHLPIKIAAIIASLTFLYTLLREVIHPLATSHQQYFYKIPILVINKVLPMVSITLLALVYLPGVIAAIVQLHNGTKYKKFPHWLDKWMLTRKQFGLLSFFFAVLHAIYSLSYPMRRSYRYKLLNWAYQQVQQNKEDAWIEHDVWRMEIYVSLGIVGLAILALLAVTSIPSVSDSLTWREFHYIQSKLGIVSLLLGTIHALIFAWNKWIDIKQFVWYTPPTFMIAVFLPIVVLIFKSILFLPCLRKKILKIRHGWEDVTKINKTEICSQL

SEQ ID NO: 53 - protein, 710 aa, HOMO SAPIENS; identical to SEQ ID NO: 32

SEQ ID NO: 54 - protein, 441 aa, Yersinia pestis
MKERSTELVQGFRHSVPYINAHRGKTFVVMLGGEAIEHENFSSIVNDIGLLHSLGIRLVVVYGARPQIDSNLADHNYEPIYHKHTRVTDARTLEMVKQAAGLLQLDITARLSMSLNNTPLQGAHINVVSGNFIIAQPLGVDDGVDYCHSGRIRRIDEEAIHRQLDNGAIVLLGPVAVSVTGESFNLTSEEVATQLAIKLKAEKMIGFCSSQGVTDSEGNIISELFPNDAQKRIEDLEQDGDYNSGTVRFLRGAVKACRSGVRRSHLLSYQEDGALIQELFSRDGIGTQIVMESAEQVRRATINDIGGILELIRPLEQQGILVRRSREQLEMEIDKFTIIERDNLTIACAALYPFPDEHIGEMACVAVHPDYRSSSRGEMLLNRITNQARQMGLKKLFVLTTRSIHWFQERGFTPAEVDVLPIQKQELYNYQRRSKILLADL

SEQ ID NO: 55 - protein, 1073 aa, HOMO SAPIENS
MKTLLLDLALWSLLFQPGWLSFSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQILMIAVFTLTGAVVLLLLVALLMLRKYRKDYELRQKKWSHIPPENIFPLETNETNHVSLKIDDDKRRDTIQRLRQCKYDKKRVILKDLKHNDGNFTEKQKIELNKLLQIDYYNLTKFYGTVKLDTMIFGVIEYCERGSLREVLNDTISYPDGTFMDWEFKISVLYDIAKGMSYLHSSKTEVHGRLKSTNCVVDSRMVVKITDFGCNSILPPKKDLWTAPEHLRQANISQKGDVYSYGIIAQEIILRKETFYTLSCRDRNEKIFRVENSNGMKPFRPDLFLETAEEKELEVYLLVKNCWEEDPEKRPDFKKIETTLAKIFGLFHDQKNESYMDTLIRRLQLYSRNLEHLVEERTQLYKAERDRADRLNFMLLPRLVVKSLKEKGFVEPELYEEVTIYFSDIVGFTTICKYSTPMEVVDMLNDIYKSFDHIVDHHDVYKVETIGDAYMVASGLPKRNGNRHAIDIAKMALEILSFMGTFELEHLPGLPIWIRIGVHSGPCAAGVVGIKMPRYCLFGDTVNTASRMESTGLPLRIHVSGSTIAILKRTECQFLYEVRGETYLKGRGNETTYWLTGMKDQKFNLPTPPTVENQQRLQAEFSDMIANSLQKRQAAGIRSQKPRRVASYKKGTLEYLQLNTTDKESTYF

SEQ ID NO: 56 - protein, 239 aa, HOMO SAPIENS
MAHAGRTGYDNREIVMKYIHYKLSQRGYEWDAGDVGAAPPGAAPAPGIFSSQPGHTPHPAASRDPVARTSPLQTPAAPGAAAGPALSPVPPVVHLTLRQAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWDAFVELYGPSMRPLFDFSWLSLKTLLSLALVGACITLGAYLGHK

SEQ ID NO: 57 - protein, 393 aa, HOMO SAPIENS [sequence omitted]

SEQ ID NO: 58 - protein, 164 aa, HOMO SAPIENS
MSEPAGDVRQNPCGSKACRRLFGPVDSEQLSRDCDALMAGCIQEARERWNFDFVTETPLEGDFAWERVRGLGLPKLYLPTGPRRGRDELGGGRRPGTSPALLQGTAEEDHVDLSLSCTLVPRSGEQAEGSPGGPGDSQGRKRRQTSMTDFYHSKRRLIFSKRKP

SEQ ID NO: 59 - protein, 110 aa, HOMO SAPIENS
MALWMRLLPLLALLALWGPDPAAAFVNQHLCGSHLVEALYLVCGERGFFYTPKTRREAEDLQVGQVELGGGPGAGSLQPLALEGSLQKRGIVEQCCTSICSLYQLENYCN

SEQ ID NO: 60 - protein, 267 aa, HOMO SAPIENS
MPRSCCSRSGALLLALLLQASMEVRGWCLESSQCQDLTTESNLLECIRACKPDLSAETPMFPGNGDEQPLTENPRKYVMGHFRWDRFGRRNSSSSGSSGAGQKREDVSAGEDCGPLPEGGPEPRSDGAKPGPREGKRSYSMEHFRWGKPVGKKRRPVKVYPNGAEDESAEAFPLEFKRELTGQRLREGDGPDGPADDGAGAQADLEHSLLVAAEKKDEGPYRMEHFRWGSPPKDKRYGGFMTSEKSQTPLVTLFKNAIIKNAYKKGE

SEQ ID NO: 61 - protein, 462 aa, HOMO SAPIENS
MASNSSSCPTPGGGHLNGYPVPPYAFFFPPMLGGLSPPGALTTLQHQLPVSGYSTPSPATIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 62 - protein, 455 aa, HOMO SAPIENS
MTTSGHACPVPAVNGHMTHYPATPYPLLFPPVIGGLSLPPLHGLHGHPPPSGCSTPSPATIETQSTSSEELVPSPPSPLPPPRVYKPCFVCQDKSSGYHYGVSACEGCKGFFRRSIQKNMIYTCHRDKNCVINKVTRNRCQYCRLQKCFEVGMSKESVRNDRNKKKKETSKQECTESYEMTAELDDLTEKIRKAHQETFPSLCQLGKYTTNSSADHRVRLDLGLWDKFSELATKCIIKIVEFAKRLPGFTGLTIADQITLLKAACLDILILRICTRYTPEQDTMTFSDGLTLNRTQMHNAGFGPLTDLVFTFANQLLPLEMDDTETGLLSAICLICGDRQDLEEPTKVDKLQEPLLEALKIYIRKRRPSKPHMFPKILMKITDLRSISAKGAERVITLKMEIPGSMPPLIQEMLENSEGHEPLTPSSSGNTAEHSPSISPSSVENSGVSQSPLVQ

SEQ ID NO: 63 - protein, 455 aa, HOMO SAPIENS; identical to SEQ ID NO: 62

SEQ ID NO: 64 - protein, 462 aa, HOMO SAPIENS
MDTKHFLPLDFSTQVNSSLTSPTGRGSMAAPSLHPSLGPGIGSPGQLHSPISTLSSPINGMGPPFSVISSPMGPHSMSVPTTPTLGFSTGSPQLSSPMNPVSSSEDIKPPLGLNGVLKVPAHPSGNMASFTKHICAICGDRSSGKHYGVYSCEGCKGFFKRTVRKDLTYTCRDNKDCLIDKRQRNRCQYCRYQKCLAMGMKREAVQEERQRGKDRNENEVESTSSANEDMPVERILEAELAVEPKTETYVEANMGLNPSSPNDPVTNICQAADKQLFTLVEWAKRIPHFSELPLDDQVILLRAGWNELLIASFSHRSIAVKDGILLATGLHVHRNSAHSAGVGAIFDRVLTELVSKMRDMQMDKTELGCLRAIVLFNPDSKGLSNPAEVEALREKVYASLEAYCKHKYPEQPGRFAKLLLRLPALRSIGLKCLEHLFFFKLIGDTPIDTFLMEMLEAPHQMT

SEQ ID NO: 65 - protein, 533 aa, HOMO SAPIENS
MSWAARPPFLPQRHAAGQCGPVGVRKEMHCGVASRWRRRRPWLDPAAAAAAAVAGGEQQTPEPEPGEAGRDGMGDSGRDSRSPDSSSPNPLPQGVPPPSPPGPPLPPSTAPSLGGSGAPPPPPMPPPPLGSPFPVISSSMGSPGLPPPAPPGFSGPVSSPQINSTVSLPGGGSGPPEDVKPPVLGVRGLHCPPPPGGPGAGKRLCAICGDRSSGKHYGVYSCEGCKGFFKRTIRKDLTYSCRDNKDCTVDKRQRNRCQYCRYQKCLATGMKREAVQEERQRGKDKDGDGEGAGGAPEEMPVDRILEAELAVEQKSDQGVEGPGGTGGSGSSPNDPVTNICQAADKQLFTLVEWAKRIPHFSSLPLDDQVILLRAGWNELLIASFSHRSIDVRDGILLATGLHVHRNSAHSAGVGAIFDRVLTELVSKMRDMRMDKTELGCLRAIILFNPDAKGLSNPSEVEVLREKVYASLETYCKQKYPEQQGRFAKLLLRLPALRSIGLKCLEHLFFFKLIGDTPIDTFLMEMLEAPHQLA

SEQ ID NO: 66 - protein, 463 aa, HOMO SAPIENS
MYGNYSHFMKFPAGYGGSPGHTGSTSMSPSAALSTGKPMDSHPSYTDTPVSAPRTLSAVGTPLNALGSPYRVITSAMGPPSGALAAPPGINLVAPPSSQLNVVNSVSSSEDIKPLPGLPGIGNMNYPSTSPGSLVKHICAICGDRSSGKHYGVYSCEGCKGFFKRTIRKDLIYTCRDNKDCLIDKRQRNRCQYCRYQKCLVMGMKREAVQEERQRSRERAESEAECATSGHEDMPVERILEAELAVEPKTESYGDMNMENSTNDPVTNICHAADKQLFTLVEWAKRIPHFSDLTLEDQVILLRAGWNELLIASFSHRSVSVQDGILLATGLHVHRSSAHSAGVGSIFDRVLTELVSKMKDMQMDKSELGCLRAIVLFNPDAKGLSNPSEVETLREKVYATLEAYTKQKYPEQPGRFAKLLLRLPALRSIGLKCLEHLFFFKLIGDTPIDTFLMEMLETPLQIT

SEQ ID NO: 67 - protein, 493 aa, HOMO SAPIENS [sequence omitted]

SEQ ID NO: 68 - protein, 185 aa, HOMO SAPIENS
MKLVSVALMYLGSLAFLGADTARLDVASEFRKKWNKWALSRGKRELRMSSSYPTGLADVKAGPAQTLIRPQDMKGASRSPEDSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 69 - protein, 498 aa, HOMO SAPIENS
MTVFLSFAFLAAILTHIGCSNQRRSPENSGRRYNRIQHGQCAYTFILPEHDGNCRESTTDQYNTNALQRDAPHVEPDFSSQKLQHLEHVMENYTQWLQKLENYIVENMKSEMAQIQQNAVQNHTATMLEIGTSLLSQTAEQTRKLTDVETQVLNQTSRLEIQLLENSLSTYKLEKQLLQQTNEILKIHEKNSLLEHKILEMEGKHKEELDTLKEEKENLQGLVTRQTYIIQELEKQLNRATTNNSVLQKQQLELMDTVHNLVNLCTKEGVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 70 - protein, 558 aa, HOMO SAPIENS
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKTFTTQETITNAETAKEWFLQAAKDPSAVAKHFVALSTNTTKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 71 - protein, 307 aa, HOMO SAPIENS
MPGQELRTVNGSQMLLVLLVLSWLPHGGALSLAEASRASFPGPSELHSEDSRFRELRKRYEDLLTRLRANQSWEDSNTDLVPAPAVRILTPEVRLGSGGHLHLRISRAALPEGLPEASRLHRALFRLSPTASRSWDVTRPLRRQLSLARPQAPALHLRLSPPPSQSDQLLAESSSARPQLELHLRPQAARGRRRARARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHC

SEQ ID NO: 72 - protein, 247 aa, HOMO SAPIENS
MTILFLTMVISYFGCMKAAPMKEANIRGQGGLAYPGVRTHGTLESVNGPKAGSRGLTSLADTFEHVIEELLDEDHKVRPNEENNKDADLYTSRVMLSSQVPLEPPLLFLLEEYKNYLDAANMSMMVLRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 73 - protein, 1754 aa, HOMO SAPIENS
MAPYPCGCHILLLLFCCLAAARANLLNLNWLWFNNEDTSHAATTIPEPQGPLPVQPTADTTTHVTPRNGSTEPATAPGSPEPPSELLEDGQDTPTSAESPDAPEENIAGVGAEILNVAKGIRSFVQLWNDTVPTESLARAETLVLETPVGPLALAGPSSTPQENGTTLWPSRGIPSSPGAHTTEAGTLPAPTPSPPSLGRPWAPLTGPSVPPPSSGRASLSSLLGGAPPWGSLQDPDSQGLSPAAAAPSQQLQRPDVRLRTPLLHPLVMGSLGKHAAPSAFSSGLPGALSQVAVTTLTRDSGAWVSHVANSVGPGLANNSALLGADPEAPAGRCLPLPPSLPVCGHLGISRFWLPNHLHHESGEQVRAGARAWGGLLQTHCHPFLAWFFCLLLVPPCGSVPPPAPPPCCQFCEALQDACWSRLGGGRLPVACASLPTQEDGYCVLIGPAAERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 74 - protein, 1763 aa, HOMO SAPIENS
MAPYPCGCHILLLLFCCLAAARANLLNLNWLWFNNEDTSHAATTIPEPQGPLPVQPTADTTTHVTPRNGSTEPATAPGSPEPPSELLEDGQDTPTSAESPDAPEENIAGVGAEILNVAKGIRSFVQLWNDTVPTESLARAETLVLETPVGPLALAGPSSTPQENGTTLWPSRGIPSSPGAHTTEAGTLPAPTPSPPSLGRPWAPLTGPSVPPPSSGRASLSSLLGGAPPWGSLQDPDSQGLSPAAAAPSQQLQRPDVRLRTPLLHPLVMGSLGKHAAPSAFSSGLPGALSQVAVTTLTRDSGAWVSHVANSVGPGLANNSALLGADPEAPAGRCLPLPPSLPVCGHLGISRFWLPNHLHHESGEQVRAGARAWGGLLQTHCHPFLAWFFCLLLVPPCGSVPPPAPPPCCQFCEALQDACWSRLGGGRLPVACASLPTQEDGYCVLIGPAAERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASKMGGSHHHHH

SEQ ID NO: 75 - protein, 1166 aa, HOMO SAPIENS
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVMRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDSTPPPHLREDDHHYSVRNSDSECPLSHDGYCLHDGVCMYIEALDKYACNCVVGYIGERCQYRDLKWWELRHAGHGQQQKVIVVAVCVVVLVMLLLLSLWGAHYYRTQKLLSKNPKNPYEESSRDVRSRRPADTEDGMSSCPQPWFVVIKEHQDLKNGGQPVAGEDGQAADGSMQPTSWRQEPQLCGMGTEQGCWIPVSSDKGSCPQVMERSFHMPSYGTQTLEGGVEKPHSLLSANPLWQQRALDPPHQMELTQ

SEQ ID NO: 76 - protein, 193 aa, HOMO SAPIENS [sequence omitted]

SEQ ID NO: 77 - protein, 288 aa, HOMO SAPIENS
MVGVGGGDVEDVTPRPGGCQISGRGARGCNGIPGAAAWEAALPRRRPRRHPSVNPRSRAAGSPRTRGRRTEERPSGSRLGDRGRGRALPGGRLGGRGRGRAPERVGGRGRGRGTAAPRAAPAARGSRPGPAGTMAAGSITTLPALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKS

SEQ ID NO: 78 - protein, 211 aa, HOMO SAPIENS
MKLWDVVAVCLVLLHTASAFPLPAGKRPPEAPAEDRSLGRRRAPFALSSDSNMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 79 - protein, 204 aa, HOMO SAPIENS
MAGPATQSPMKLMALQLLLWHSALWTVQEATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 80 - protein, 144 aa, HOMO SAPIENS
MWLQSLLLLGTVACSISAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 81 - protein, 454 aa, HOMO SAPIENS
MARPNKFLLWFCCFAWLCFPISLGSQASGGEAQIAASAELESGAMPWSLLQHIDERDRAGLLPALFKVLSVGRGGSPRLQPDSRALHYMKKLYKTYATKEGIPKSNRSHLYNTVRLFTPCTRHKQAPGDQVTGILPSVELLFNLDRITTVEHLLKSVLLYNINNSVSFSSAVKCVCNLMIKEPKSSSRTLGRAPYSFTFNSQFEFGKKHKWIQIDVTSLLQPLVASNKRSIHMSINFTCMKDQLEHPSAQNGLFNMTLVSPSLILYLNDTSAQAYHSWYSLHYKRRPSQGPDQERSLSAYPVGEEAAEDGRSSHHRHRRGQETVSSELKKPLGPASFNLSEYFRQFLLPQNECELHDFRLSFSQLKWDNWIVAPHRYNPRYCKGDCPRAVGHRYGSPVHTMVQNIIYEKLDSSVPRPSCVPAKYSPLSVLTIEPDGSIAYKEYEDMIATKCTCR

SEQ ID NO: 82 - protein, 728 aa, HOMO SAPIENS
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIPNRPGIFVRVAYYAKWIHKIILTYKVPQS

SEQ ID NO: 83 - protein, 240 aa, HOMO SAPIENS
MSRSNRQKEYKCGDLVFAKMKGYPHWPARIDEMPEAAVKSTANKYQVFFFGTHETAFLGPKDLFPYEESKEKFGKPNKRKGFSEGLWEIENNPTVKASGYQSSQKKSCVEEPEPEPEAAEGDGDKKGNAEGSSDEEGKLVIDEPAKEKNEKGALKRRAGDLLEDSPKRPKEAENPEGEEKEAATLEVERPLPMEVEKNSTPSEPGSGRGPPQEEEEEEDEEEEATKEDAEAPGIRDHESL

SEQ ID NO: 84 - protein, 153 aa, HOMO SAPIENS
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKEVHLKNASRGSAGNKNYRM

SEQ ID NO: 85 - protein, 657 aa, HOMO SAPIENS [sequence omitted]

SEQ ID NO: 86 - protein, 375 aa, HOMO SAPIENS
MQKLQLCVYIYLFMLIVAGPVDLNENSEQKENVEKEGLCNACTWRQNTKSSRIEAIKIQILSKLRLETAPNISKDVIRQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 87 - protein, 257 aa, HOMO SAPIENS
MSILFYVIFLAYLRGIQGNNMDQRSLPEDSLNSLIIKLIQADILKNKLSKQMVDVKENYQSTLPKAEAPREPERGGPAKSAFQPVIAMDTELLRQQRRYNSPRVLLSDSTPLEPPPLYLMEDYVGSPVVANRTSRRKRYAEHKSHRGEYSVCDSESLWVTDKSSAIDIRGHQVTVLGEIKTGNSPVKQYFYETRCKEARPVKNGCRGIDDKHWNSQCKTSQTYVRALTSENNKLVGWRWIRIDTSCVCALSRKIGRT

SEQ ID NO: 88 - protein, 211 aa, HOMO SAPIENS [sequence omitted]

SEQ ID NO: 89 - protein, 353 aa, HOMO SAPIENS [sequence omitted]

SEQ ID NO: 90 - protein, 159 aa, HOMO SAPIENS
MVPSAGQLALFALGIVLAACQALENSTSPLSDPPVAAAVVSHFNDCPDSHTQFCFHGTCRFLVQEDKPACVCHSGYVGARCEHADLLAVVAASQKKQAITALVVVSIVALAVLIITCVLIHCCQVRKHCEWCRALICRHEKPSALLKGRTACCHSETVV

SEQ ID NO: 91 - protein, 390 aa, HOMO SAPIENS
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 92 - protein, 233 aa, HOMO SAPIENS
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 93 - protein, 191 aa, HOMO SAPIENS
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 94 - protein, 170 aa, HOMO SAPIENS
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERRRPKGRGKRRREKQRPTDCHLCGDAVPRR

SEQ ID NO: 95 - protein, 270 aa, Ricinus communis
DNNIFPKQYPIINFTTAGATVQSYTNFIRAVRGRLTTGADVRHEIPVLPNRVGLPINQRFILVELSNHAELSVTLALDVTNAYVVGYRAGNSAYFFHPDNQEDAEAITHLFTDVQNRYTFAFGGNYDRLEQLAGNLRENIELGNGPLEEAISALYYYSTGGTQLPTLARSFIICIQMISEAARFQYIEGEMRTRIRYNRRSAPDPSVITLENSWGRLSTAIQESNQGAFASPIQLQRRNGSKFSVYDVSILIPIIALMVYRCAPPPSSQF

SEQ ID NO: 96 - protein, 262 aa, Ricinus communis
ADVCMDPEPIVRIVGRNGLCVDVRDGRFHNGNAIQLWPCKSNTDANQLWTLKRDNTIRSNGKCLTTYGYSPGVYVMIYDCNTAATDATRWQIWDNGTIINPRSSLVLAATSGNSGTTLTVQTNIYAVSQGWLPTNNTQPFVTTIVGLYGLCLQANSGQVWIEDCSSEKAEQQWALYADGSIRPQQNRDNCLTSDSNIRETVVKILSCGPASSGQRWMFKNDGTILNLYSGLVLDVRASDPSLKQIILYPLHGDPNQIWLPLF

SEQ ID NO: 97 - protein, 560 aa, Corynebacterium diphtheriae
  misc_feature (9)..(9): Xaa can be any naturally occurring amino acid
  misc_feature (139)..(139): Xaa can be any naturally occurring amino acid
  misc_feature (149)..(149): Xaa can be any naturally occurring amino acid
  misc_feature (510)..(510): Xaa can be any naturally occurring amino acid
  misc_feature (525)..(525): Xaa can be any naturally occurring amino acid
  misc_feature (558)..(558): Xaa can be any naturally occurring amino acid
MSRKLFASXLIGALLGIGAPPSAHAGADDVVDSSKSFVMENFSSYHGTKPGYVDSIQKGIQKPKSGTQRNYDDDWKGFYSTDNKYDAAGYSVDNENPLSGKAGDVVKVTYPGLTKVLALKVDNAETIKKELGLSLTEPXMEQVGTEEFXKRFGDGASRVVLSLPFAEGSSSVEYINNWEQAKALSVKLEINFETRGKRGQDAMYEYMAQACAGNRVRRSVGRSLSCINLDWDVIRDKTKTKIESLKEHGPIKNKMSESPNKTVSQEKAKQYLEEFHQTALEHPQLSELKTVTGTNPLFAGANYAAWAVNVAQVIDSETADNLEKTTAALSILPGIGSVMGIADGAVHHNTEEIVAQSIALSSLMVAQAIPLVGELVDIGFAPYNFVESIINLFQVVHNSYNRSAYSPGHKTQPFLHDGYAVSWNTVEDSIIRTGFQGESGHDIKITAENTPLPIASVLLPTIPGKLDVNKSKTHISVNGRKIRMRCRAIDGDVTFCRPKSPVYVGNGVHXNLHVAFHRSSSEKIXSNEISSDSIGVLGYQKTVDHTKVNSKLSLFFEXKS

SEQ ID NO: 98 - protein, 638 aa, Pseudomonas aeruginosa
MHLTPHWIPLVASLGLLAGGSFASAAEEAFDLWNECAKACVLDLKDGVRSSRMSVDPAIADTNGQGVLHYSMVLEGGNDALKLAIDNALSITSDGLTIRLEGGVEPNKPVRYSYTRQARGSWSLNWLVPIGHEKPSNIKVFIHELNAGNQLSHMSPIYTIEMGDELLAKLARDATFFVRAHESNEMQPTLAISHAGVSVVMAQAQPRREKRWSEWASGKVLCLLDPLDGVYNYLAQQRCNLDDTWEGKIYRVLAGNPAKHDLDIKPTVISHRLHFPEGGSLAALTAHQACHLPLETFTRHRQPRGWEQLEQCGYPVQRLVALYLAARLSWNQVDQVIRNALASPGSGGDLGEAIREQPEQARLALTLAAAESERFVRQGTGNDEAGAASADVVSLTCPVAAGECAGPADSGDALLERNYPTGAEFLGDGGDISFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTGLTLAAPEAAGEVERLIGHPLPLRLDAITGPEEEGGRLETILGWPLAERTVVIPSAIPTDPRNVGGDLDPSSIPDKEQAISALPDYASQPGKPPREDLK

SEQ ID NO: 99 - protein, 316 aa, Gelonium multiflorum
MKGNMKVYWIKIAVATWFCCTTIVLGSTARIFSLPTNDEEETSKTLGLDTVSFSTKGATYITYVNFLNELRVKLKPEGNSHGIPLLRKKCDDPGKCFVLVALSNDNGQLAEIAIDVTSVYVVGYQVRNRSYFFKDAPDAAYEGLFKNTIKTRLHFGGSYPSLEGEKAYRETTDLGIEPLRIGIKKLDENAIDNYKPTEIASSLLVVIQMVSEAARFTFIENQIRNNFQQRIRPANNTISLENKWGKLSFQIRTSGANGMFSEAVELERANGKKYYVTAVDQVKPKIALLKFVDKDPKTSLAAELIIQNYESLVGFD

SEQ ID NO: 100 - protein, 292 aa, Saponaria officinalis
MKIYVVATIAWILLQFSAWTTTDAVTSITLDLVNPTAGQYSSFVDKIRNNVKDPNLKYGGTDIAVIGPPSKDKFLRINFQSSRGTVSLGLKRDNLYVVAYLAMDNTNVNRAYYFKSEITSAELTALFPEATTANQKALEYTEDYQSIEKNAQITQGDKSRKELGLGIDLLLTFMEAVNKKARVVKNEARFLLIAIQMTAEVARFRYIQNLVTKNFPNKFDSDNKVIQFEVSWRKISTAIYGDAKNGVFNKDYDFGFGKVRQVKDLQMGLLMYLGKPKSSNEANSTAYATTVL

SEQ ID NO: 101 - protein, 386 aa, Pseudomonas aeruginosa
LAGNPAKHDLDIKPTVISHRLHFPEGGSLAALTAHQACHLPLETFTRHRQPRGWEQLEQCGYPVQRLVALYLAARLSWNQVDQVIRNALASPGSGGDLGEAIREQPEQARLALTLAAAESERFVRQGTGNDEAGAASADVVSLTCPVAAGECAGPADSGDALLERNYPTGAEFLGDGGDISFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTGLTLAAPEAAGEVERLIGHPLPLRLDAITGPEEEGGRLETILGWPLAERTVVIPSAIPTDPRNVGGDLDPSSIPDKEQAISALPDYASQPGKPPREDLK

SEQ ID NO: 102 - protein, 370 aa, Pseudomonas aeruginosa
LAGNPAKHDLDIKPTVISHRLHFPEGGSLAALTAHQACHLPLETFTRHRQPRGWEQLEQCGYPVQRLVALYLAARLSWNQVDQVIRNALASPGSGGDLGEAIREQPEQARLAGNDEAGAASADVVSLTCPVAAGECAGPADSGDALLERNYPTGAEFLGDGGDISFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTGLTLAAPEAAGEVERLIGHPLPLRLDAITGPEEEGGRLETILGWPLAERTVVIPSAIPTDPRNVGGDLDPSSIPDKEQAISALPDYASQPGKPPREDLK

SEQ ID NO: 103 - protein, 1620 aa, HOMO SAPIENS
MGAIGLLWLLPLLLSTAAVGSGMGTGQRAGSPAAGPPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEISVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 104 - protein, 6 aa, Artificial Sequence
  PSA derived peptide
HSSKLQ

SEQ ID NO: 105 - protein, 1255 aa, HOMO SAPIENS
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 106 - protein, 7 aa, Artificial Sequence
  PSA PEPTIDE FRAGMENT
HSSKLQK

SEQ ID NO: 107 - protein, 202 aa, HOMO SAPIENS
MCYGKCARCIGHSLVGLALLCIAANILLYFPNGETKYASENHLSRFVWFFSGIVGGGLLMLLPAFVFIGLEQDDCCGCCGHENCGKRCAMLSSVLAALIGIAGSGYCVIVAALGLAEGPLCLDSLGQWNYTFASTEGQYLLDTSTWSECTEPKHIVEWNVSLFSILLALGGIEFILCLIQVINGVLGGICGFCCSHQQQYDC

SEQ ID NO: 108 - protein, 7 aa, Artificial Sequence
  PSA PEPTIDE FRAGMENT
  X (6)..(6): ETHANYL-D-ALANINE
HSSKLXK

SEQ ID NO: 109 - protein, 530 aa, HOMO SAPIENS
MRRLWGAARKPSGAGWEKEWAEAPQEAPGAWSGRLGPGRSGRKGRAVPGWASWPAHLALAARPARHLGGAGQGPRPLHSGTAPFHSRASGERQRRLEPQLQHESRCRSSTPADAWRAEAALPVRAMGAPWGSPTAAAGGRRGWRRGRGLPWTVCVLAAAGLTCTALITYACWGQLPPLPWASPTPSRPVGVLLWWEPFGGRDSAPRPPPDCRLRFNISGCRLLTDRASYGEAQAVLFHHRDLVKGPPDWPPPWGIQAHTAEEVDLRVLDYEEAAAAAEALATSSPRPPGQRWVWMNFESPSHSPGLRSLASNLFNWTLSYRADSDVFVPYGYLYPRSHPGDPPSGLAPPLSRKQGLVAWVVSHWDERQARVRYYHQLSQHVTVDVFGRGGPGQPVPEIGLLHTVARYKFYLAFENSQHLDYITEKLWRNALLAGAVPVVLGPDRANYERFVPRGAFIHVDDFPSASSLASYLLFLDRNPAVYRRYFHWRRSYAVHITSFWDEPWCRVCQAVQRAGDRPKSIRNLASWFER

SEQ ID NO: 110 - protein, 609 aa, HOMO SAPIENS
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 111 - protein, 6 aa, Artificial Sequence
  PSA PEPTIDE FRAGMENT
  B (1)..(1): 4-HYDROXYPROLINE
  X (4)..(4): CYCLOHEXYL GLYCINE
BASXQS

SEQ ID NO: 112 - protein, 550 aa, HOMO SAPIENS
MPRIPASPLSCCPPDMLGPCMLLLLLLLGLRLQLSLGIIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGRSVVPALLPLLAGTLLLLETATAP

SEQ ID NO: 113 - protein, 261 aa, HOMO SAPIENS
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 114 - protein, 750 aa, HOMO SAPIENS; identical to SEQ ID NO: 42

SEQ ID NO: 115 - protein, 386 aa, HOMO SAPIENS
MRAAPLLLARAASLNLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALVPPEGVSIWNPILLWQPIPVHTVPLSEDQLLYLPFRNCPRFQELESETLKSEEFQKRLHPYKDFIATLGKLSGLHGQDLFGIWSKVYDPLYCESVHNFTLPSRATEDTMTKLRELSELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQGTEDSTD

SEQ ID NO: 116 - protein, 7 aa, Artificial Sequence
  PSA PEPTIDE FRAGMENT
  B (1)..(1): 4-HYDROXYPROLINE
  X (4)..(4): CYCLOHEXYL GLYCINE
BASXQSL

SEQ ID NO: 117 - protein, 309 aa, HOMO SAPIENS
MSLEQRSLHCKPEEALEAQQEALGLVCVQAATSSSSPLVLGTLEEVPTAGSTDPPQSPQGASAFPTTINFTRQRQPSEGSSSREEEGPSTSCILESLFRAVITKKVADLVGFLLLKYRAREPVTKAEMLESVIKNYKHCFPEIFGKASESLQLVFGIDVKEADPTGHSYVLVTCLGLSYDGLLGDNQIMPKTGFLIIVLVMIAMEGGHAPEEEIWEELSVMEVYDGREHSAYGEPRKLLTQDLVQEKYLEYRQVPDSDPARYEFLWGPRALAETSYVKVLEYVIKVSARVRFFFPSLREAALREEEEGV

SEQ ID NO: 118 - protein, 314 aa, HOMO SAPIENS
MPLEQRSQHCKPEEGLEARGEALGLVGAQAPATEEQQTASSSSTLVEVTLGEVPAADSPSPPHSPQGASSFSTTINYTLWRQSDEGSSNQEEEGPRMFPDLESEFQAAISRKMVELVHFLLLKYRAREPVTKAEMLESVLRNCQDFFPVIFSKASEYLQLVFGIEVVEVVPISHLYILVTCLGLSYDGLLGDNQVMPKTGLLIIVLAIIAIEGDCAPEEKIWEELSMLEVFEGREDSVFAHPRKLLMQDLVQENYLEYRQVPGSDPACYEFLWGPRALIETSYVKVLHHTLKIGGEPHISYPPLHERALREGEE

SEQ ID NO: 119 - protein, 314 aa, HOMO SAPIENS
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAELVHFLLLKYRAREPVTKAEMLGSVVGNWQYFFPVIFSKASSSLQLVFGIELMEVDPIGHLYIFATCLGLSYDGLLGDNQIMPKAGLLIIVLAIIAREGDCAPEEKIWEELSVLEVFEGREDSILGDPKKLLTQHFVQENYLEYRQVPGSDPACYEFLWGPRALVETSYVKVLHHMVKISGGPHISYPPLHEWVLREGEE

SEQ ID NO: 120 - protein, 317 aa, HOMO SAPIENS [sequence omitted]

SEQ ID NO: 121 - protein, 760 aa, HOMO SAPIENS; identical to SEQ ID NO: 35

SEQ ID NO: 122 - protein, 1058 aa, HOMO SAPIENS
MDLGPLNICEEMTILHGGFLLAEQLFHPKALAELTKSDWERVGRPIVEALREISSAAAHSQPFAWKKKALIIIWAKVLQPHPVTPSDTETRWQEDLFFSVGNMIPTINHTILFELLKSLEASGLFIQLLMALPTTICHAELERFLEHVTVDTSAEDVAFFLDVWWEVMKHKGHPQDPLLSQFSAMAHKYLPALDEFPHPPKRLRSDPDACPTMPLLAMLLRGLTQIQSRILGPGRKCCALANLADMLTVFALTEDDPQEVSATVYLDKLATVISVWNSDTQNPYHQQALAEKVKEAERDVSLTSLAKLPSETIFVGCEFLHHLLREWGEELQAVLRSSQGTSYDSYRLCDSLTSFSQNATLYLNRTSLSKEDRQVVSELAECVRDFLRKTSTVLKNRALEDITASIAMAVIQQKMDRHMEVCYIFASEKKWAFSDEWVACLGSNRALFRQPDLVLRLLETVIDVSTADRAIPESQIRQVIHLILECYADLSLPGKNKVLAGILRSWGRKGLSEKLLAYVEGFQEDLNTTFNQLTQSASEQGLAKAVASVARLVIVHPEVTVKKMCSLAVVNLGTHKFLAQILTAFPALRFVEEQGPNSSATFMVSCLKETVWMKFSTPKEEKQFLELLNCLMSPVKPQGIPVAALLEPDEVLKEFVLPFLRLDVEEVDLSLRIFIQTLEANACREEYWLQTCSPFPLLFSLCQLLDRFSKYWQLPKEKRCLSLDRKDLAIHILELLCEIVSANAETFSPDVWIKSLSWLHRKLEQLDWTVGLRLKSFFEGHFKCEVPATLFEICKLSEDEWTSQAHPGYGAGTGLLAWMECCCVSSGISERMLSLLVVDVGNPEEVRLFSKGFLVALVQVMPWCSPQEWQRLHQLTRRLLEKQLLHVPYSLEYIQFVPLLNLKPFAQELQLSVLFLRTFQFLCSHSCRDWLPLEGWNHVVKLLCGSLTRLLDSVRAIQAAGPWVQGPEQDLTQEALFVYTQVFCHALHIMAMLHPEVCEPLYVLALETLTCYETLSKTNPSVSSLLQRAHEQRFLKSIAEGIGPEERRQTLLQKMSSF

SEQ ID NO: 123 - protein, 255 aa, HOMO SAPIENS; identical to SEQ ID NO: 44

SEQ ID NO: 124 - protein, 702 aa, HOMO SAPIENS; identical to SEQ ID NO: 40

SEQ ID NO: 125 - protein, 661 aa, HOMO SAPIENS
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 126 - protein, 118 aa, HOMO SAPIENS
MPREDAHFIYGYPKKGHGHSYTTAEEAAGIGILTVILGVLLLIGCWYCRRRNGYRALMDKSLHVGTQCALTRRCPQEGFDHRDSKVSLQEKNCEPVVPNAPPAYEKLSAEQSPPPYSP

SEQ ID NO: 127 - protein, 8 aa, Artificial Sequence
  PSA PEPTIDE FRAGMENT
  B (1)..(1): 4-HYDROXYPROLINE
  X (4)..(4): CYCLOHEXYL GLYCINE
BSSXQSSP

SEQ ID NO: 128 - protein, 351 aa, HOMO SAPIENS; identical to SEQ ID NO: 1

SEQ ID NO: 129 - protein, 297 aa, HOMO SAPIENS; identical to SEQ ID NO: 6

SEQ ID NO: 130 - protein, 61 aa, HOMO SAPIENS
MKRFLFLLLTISLLVMVQIQTGLSGQNDTSQTSSPSASSSMSGGIFLFFVANAIIHLFCFS

SEQ ID NO: 131 - protein, 8 aa, Artificial Sequence
  PSA PEPTIDE FRAGMENT
  Z (1)..(1): 4-O-ACETYL-HYDROXYPROLINE
  X (4)..(4): CYCLOHEXYL GLYCINE
ZSSXQSSP

SEQ ID NO: 132 - protein, 8 aa, Artificial Sequence
  PSA PEPTIDE FRAGMENT
RRSSYYSG

SEQ ID NO: 133 - protein, 164 aa, HOMO SAPIENS
EMLQGLLLLLLLSMGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQ

SEQ ID NO: 134 - protein, 300 aa, HOMO SAPIENS
MANCEFSPVSGDKPCCRLSRRAQLCLGVSILVLILVVVLAVVVPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 135 - protein, 277 aa, HOMO SAPIENS
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 136 - protein, 6 aa, Artificial Sequence
  PSA FRAGMRNT PEPTIDE
SSKYQL

SEQ ID NO: 137 - protein, 7 aa, Artificial Sequence
  PSA FRAGMENT PEPTIDE
  B (1)..(1): N-GLUTARYL-4 HYDROXYPROLINE
  X (4)..(4): CYCLOHEXYL GLYCINE
BASXQSL

SEQ ID NO: 138 - protein, 5 aa, Artificial Sequence
  CASPASE-3 PEPTIDE FRAGMENT
DEVDP

SEQ ID NO: 139 - protein, 8 aa, Artificial Sequence
  CASPASE-3 PEPTIDE FRAGMENT
KGSGDVEG

SEQ ID NO: 140 - protein, 646 aa, HOMO SAPIENS
MGLPRLVCAFLLAACCCCPRVAGVPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQAWNLDTMISLLSEPQELLVNYVSDVRVSPAAPERQEGSSLTLTCEAESSQDLEFQWLREETDQVLERGPVLQLHDLKREAGGGYRCVASVPSIPGLNRTQLVKLAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRGVVIVAVIVCILVLAVLGAVLYFLYKKGKLPCRRSGKQEITLPPSRKTELVVEVKSDKLPEEMGLLQGSSGDKRAPGDQGEKYIDLRH

SEQ ID NO: 141 - protein, 4 aa, Artificial Sequence
  CATHEPSIN B PEPTIDE FRAGMENT
GFLG

SEQ ID NO: 142 - protein, 4 aa, Artificial Sequence
  CATHEPSIN B PEPTIDE FRAGMENT
KKFA

SEQ ID NO: 143 - protein, 1210 aa, HOMO SAPIENS; identical to SEQ ID NO: 31

SEQ ID NO: 144 - protein, 4 aa, Artificial Sequence
  CATHEPSIN B PEPTIDE FRAGMENT
AFKK

SEQ ID NO: 145 - protein, 4 aa, Artificial Sequence
  CATHEPSIN B PEPTIDE FRAGMENT
GFLG

SEQ ID NO: 146 - protein, 9 aa, Artificial Sequence
  FAP PEPTIDE FRAGMENT
KQEQNPGST

SEQ ID NO: 147 - protein, 11 aa, Artificial Sequence
  Synthetic polypeptide
ACDCRGDCFCG

SEQ ID NO: 148 - protein, 13 aa, Artificial Sequence
  Synthetic polypeptide
DGARYCRGDCFDG

SEQ ID NO: 149 - protein, 5 aa, Artificial Sequence
  Cathepsin B fragment
RGDYK

SEQ ID NO: 150 - protein, 5 aa, Homo sapiens
RGDFK

SEQ ID NO: 151 - protein, 10 aa, Homo sapiens
RGDYKKYDGR

SEQ ID NO: 152 - protein, 14 aa, Artificial Sequence
  Cathepsin B fragment
CAGKNFFWKTFTSC

SEQ ID NO: 153 - protein, 5 aa, Artificial Sequence
  Cathepsin B fragment
  X (5)..(5): N-methyl valine
RGDFX

SEQ ID NO: 154 - protein, 5 aa, Homo sapiens
PHSCN

SEQ ID NO: 155 - protein, 5 aa, Homo sapiens
  X (1)..(1): Acetylated PRO
  Z (5)..(5): Amidated ASN
XHSCZ

SEQ ID NO: 156 - protein, 25 aa, HOMO SAPIENS
TMPFLFCNVNDVCNFASRNDYSYWL

SEQ ID NO: 157 - protein, 4 aa, Artificial Sequence
  Cathepsin B fragment
YSNS

SEQ ID NO: 158 - protein, 5 aa, Artificial Sequence
  Cathepsin B fragment
YSNSG

SEQ ID NO: 159 - protein, 20 aa, Artificial Sequence
  Cathepsin B fragment
FLSSRLQDLYSIVRRADRAA

SEQ ID NO: 160 - protein, 11 aa, Artificial Sequence
  Cathepsin B fragment
IVRRADRAAVP

SEQ ID NO: 161 - protein, 13 aa, Artificial Sequence
  Cathepsin B fragment
RQVFQVAYIIIKA

SEQ ID NO: 162 - protein, 12 aa, Artificial Sequence
  Cathepsin B fragment
KAFDITYVRLKF

SEQ ID NO: 163 - protein, 12 aa, Artificial Sequence
  Laminin Peptide C16S
DFKLFAVTIKYR

SEQ ID NO: 164 - protein, 8 aa, Artificial Sequence
  Cathepsin B fragment
CPQPRPLC

SEQ ID NO: 165 - protein, 503 aa, HOMO SAPIENS
MLSQLAMLQGSLLLVVATMSVAQQTRQEADRGCETLVVQHGHCSYTFLLPKSEPCPPGPEVSRDSNTLQRESLANPLHLGKLPTQQVKQLEQALQNNTQWLKKLERAIKTILRSKLEQVQQQMAQNQTAPMLELGTSLLNQTTAQIRKLTDMEAQLLNQTSRMDAQMPETFLSTNKLENQLLLQRQKLQQLQGQNSALEKRLQALETKQQEELASILSKKAKLLNTLSRQSAALTNIERGLRGVRHNSSLLQDQQHSLRQLLVLLRHLVQERANASAPAFIMAGEQVFQDCAEIQRSGASASGVYTIQVSNATKPRKVFCDLQSSGGRWTLIQRRENGTVNFQRNWKDYKQGFGDPAGEHWLGNEVVHQLTRRAAYSLRVELQDWEGHEAYAQYEHFHLGSENQLYRLSVVGYSGSAGRQSSLVLQNTSFSTLDSDNDHCLCKCAQVMSGGWWFDACGLSNLNGVYYHAPDNKYKMDGIRWHYFKGPSYSLRASRMMIRPLDI

SEQ ID NO: 166 - protein, 369 aa, HOMO SAPIENS
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 167 - protein, 196 aa, HOMO SAPIENS
MRTLACLLLLGCGYLAHVLAEEAEIPREVIERLARSQIHSIRDLQRLLEIDSVGSEDSLDTSLRAHGVHATKHVPEKRPLPIRRKRSIEEAVPAVCKTRTVIYEIPRSQVDPTSANFLIWPPCVEVKRCTGCCNTSSVKCQPSRVHHRSVKVAKVEYVRKKPKLKEVQVRLEEHLECACATTSLNPDYREEDTDVR

SEQ ID NO: 168 - protein, 226 aa, HOMO SAPIENS
MFIMGLGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 169 - protein, 322 aa, HOMO SAPIENS
MRTSKCFLKTASSQRNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 170 - protein, 364 aa, HOMO SAPIENS
MHRLIFVYTLICANFCSCRDTSATPQSASIKALRNANLRRDDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 171 - protein, 6 aa, Artificial Sequence
  KALLIKREIN 2 PEPTIDE FRAGMENT
GKAFRR

SEQ ID NO: 172 - protein, 7 aa, Artificial Sequence
  MMP-2/-9/ PEPTIDE FRAGMENT
  Z (3)..(3): CITRULLINE
  X (5)..(5): HOMOPHENYLALANINE
EPZGXYL

SEQ ID NO: 173 - protein, 6 aa, Artificial Sequence
  MMP-2/-9/ PEPTIDE FRAGMENT
GILGVP

SEQ ID NO: 174 - protein, 8 aa, Artificial Sequence
  MMP-2/-9/ PEPTIDE FRAGMENT
GPLGIAGQ

SEQ ID NO: 175 - protein, 8 aa, Artificial Sequence
  MMP-7 PEPTIDE FRAGMENT
KRALGLPG

SEQ ID NO: 176 - protein, 8 aa, Artificial Sequence
  MMP-7 PEPTIDE FRAGMENT
RPLALWRS

SEQ ID NO: 177 - protein, 4 aa, Artificial Sequence
  uPA PEPTIDE FRAGMENT
  X (4)..(4): PARA-AMINOBENZOYLCARBOXYL
AFKX

SEQ ID NO: 178 - protein, 4 aa, Artificial Sequence
  CATHEPSIN K PEPTIDE FRAGMENT
  Z (4)..(4): NORLEUCINE
  X (4)..(4): NORLEUCINE
GGPX

SEQ ID NO: 179 - protein, 4 aa, Artificial Sequence
  PLASMIN PEPTIDE FRAGMENT
AFKK

SEQ ID NO: 180 - protein, 11 aa, Artificial Sequence
  THROMBIN PEPTIDE FRAGMENT
  X (1)..(1): POLY-L-LYSINE
  Z (4)..(4): PIPERIDINE
XGFZRSGGGGG

SEQ ID NO: 181 - protein, 8 aa, Artificial Sequence
  TRYPSIN PEPTIDE FRAGMENT
  X (1)..(1): POLY-L-LYSINE
XGASRFTG

What is claimed is:

1. A compound comprising: an illudofulvene moiety selected from the group consisting of analogs 115, 121, 122, 127, 146, 255 and 289.

2. A composition comprising the compound of claim 1, and a physiologically compatible excipient.

3. A composition comprising racemic mixtures of any enantiomers of the compound of claim 1.

4. A composition comprising the compound of claim 1, in the form of a liposomal particle, a nanoparticle, or a PEGylated compound.

5. A composition comprising the compound of claim 1, and a physiologically compatible carrier.

\* \* \* \* \*